United States Patent 12,790,634 (MOST PROBABLE NUMBER ANALYSIS OF HETEROGENOUS POPULATIONS) - sequence listing, part 25

SEQ ID NO: 16 - DNA, 5630355 bp, unidentified (residues 1-1,876,785 of 5,630,355)
  source 1..5630355: mol_type = genomic DNA; note = Otoolea symbiosa
aaaagctgttctgtgaatacgaccaggaagtgaagcactacccggaaaagcgtggtatcgtccacaatgaaatccttcttccggcaaatgccccacagaaatatgcagaccgcaataccctatggaacgccgccgaagcggtggagaaacaatggaactcccagcttgcaaggcggtgggtgcttaccatccccagagagataccgcctgaccagtacgctgtccttgtacgggagttttgtgagcagcagtttgtttccaaaggcatgattgctgattttgcaatccataacccccatccgccgggacacaatccccacgcccatgtcctgctcactatgagggcaatggacgaacatgggaaatggcttcccaagagccgcaaggtttatgaccttgacgagaatggggaacggatcaaacttccgtccggcagatggaaaagccacaaggaggatacggttgactggaacgaccagaagtattgtgaaatctggcggcatgaatgggaggtcatccagaaccgctatctggaagccaatgaccgcccggagcgtgtggacttgcgttcctatgccagacaggggcttgatatagtccctactgtccatgagggagctgctgtccggcagatggaaaagcggggtatccagacgaatatcggaaacctgaaccgggaaatcaaagccgccaacagcctgatgaagtccatccggcagcttatccaaaacctcaaaggctggattaccgagctgggcgaaaaacggaaagagctgcttgcacaaaaggcggcggaggaagcaacacttcttcccaatctgctgatgaagtatatggcgatacgaaaggaagaacggaaggactggacaagggctggacagaaccgggggacttcacaggacttaaaggcagtcagcgaagccctgtcctatctccggcaaaaggggctttccactgtggaggacttagaagcatttctggaatcttccgggaaatcagccgcagattaccgcaatcagatgaagccaaaggaagcccggagcaaagtgattgacgggattcttgccagccggacagactgcaaagaatgtaaggctgtttatgagaagtaccagaagatattttttaagaaaacaaaggagaaattcaaacaggaacacccggaggttgcccggtatgagaaagccgctgactaccttgccaagcacccggacgataaggacagtacccaaaaggagctgcaagaggagcaggaaacgcttctcagcgaaatcgcagaactgaaagtaccgctgaccgaggtgcaggaagatttgaagaagctgcgggacatccgctactgggtacggaaagccacacccggcacagaagaaagcaaagagccgcccaagaagcagcccctcaaagaagtcttgcaggataaggcggacgagaagaaagcacagaaaaacgccccggcgcagacgaaacacaaacaacaggatatggaactttaacaggcacttgccattttcagattgagaatgataagtgccttttcttttttacaaggaggaattgatttgaatgtatttgaagctgtgaagcagtccgtcacaacaagacaggctgcggagcattatggaatccgtgtaggccggaacgggatggcttgttgcccgttccataacgataaaaccccaagcatgaagctggatcggcgttaccactgcttcggctgcggtgcggatggggatgtgattgattttgccgccgccctgtatgggctgggaaagaaagaagccgccgtacagctggcacaggacttcgggctttcctatgaggactggaaaccgccggggaaggtaaaaaagcccaagccccggcagaaatcccaggaggaacagtttcaggaagcaaagagccgctgcttccgtatccttgccgattatctccacctgcttagggcatggagaaaggattatgtcccgcactccccggaggaagccgttcatccccggtttgtggaagccttacagaagcaagcccaagtggaatatctgctggatgtgctgctgttcggggagacagaggaaaaagcggctttgattacggactacggaaaggatgtgatacagcttgaacaacgaatggcagagcttgcagccgcagacgcagcaagaactaaaaaacaccatgaacgctatgcagccgccccagagcattgaggaaatcaaggcggggctggaaactaccgagaaaggcggtgtccgtcagagcatacggaactgcctgaccgtattccagcgtgacccgctgctttccggggctatcgcatacaacatcctgaccgaccgcaaggacatcataaagcccatcggttttcacagagaaagcacagccctgaccgatacggacatgaagtatctgcttctctatctggaggaaacctacgggcttaccagtgagaaaaagattgaaaccgccatcgggattgtggcgaatgagaataagtaccaccccatccgggattttctgaacagccttgcatgggacgggactgagcgcatccgcttctgtctgcggcactttctgggagctgatgtggacgattacacctatgaagccttgaagctgttcctgctgggtgcaatctcacgagcctttcagccagggtgcaaatttgaaatcatgctgtgtctggtaggcggtcagggggctggcaaatccaccttcttccggctgctggcagtccgggacgagtggttttccgatgatttgcggaagctggacgatgataacgtgtaccgcaagctgcaaggtcactggataattgaaatgtcggaaatgatggcaaccgccaatgccaagagcattgaggaaatcaagtcctttctaagccgccagaaagaggtttacaaaattccctatgaaactcacccggcagaccgcccccgtcaatgcgtgttcggcggcacttccaacgcccttgactttctcccccttgaccgttccggcaaccgccgatttatcccggtcatggtgtacccggagcaagccgaggttcacattttggaggacgaagccgcttccagagcctatatcagccagatgtgggcggaagcaatggagatttaccgaagcggcatgttcaagctgtcattcagcccagccatgcagcggtatctcaaagaacaccagcgggattttatgccggaggacaccaaagccgggatgatacaggcgtatcttgataagtacaccgggagcatggtctgctccaagcagctctacaaggaagccttgaaccatgcctttgacgagccgaaacaatgggaaatccgggaaatcaacgagattatgaaccagtgcattaccgggtggaactacttttccaatccgaggatgtttgcggaatacggcagacaaaagggctgggagcgtgaaatcccggcaacggacaccgacaacccgcccgaaaaatctatggacggttttgtggaggtcacagagcagatggagcttccattctgaaaatgacagcccgttgccgacttcgttgctatcccgttgccgagccggttgccggggaaaatcccttatttccgggctttttccctctctgacaaccaaaacaacagaaaaataaaagaaaagtataaatagtaatcaacgccagattgagattgtttgcaaggtcttttgaagcccgttgccggacttcgttgccgaccgttctctgtctggctattttcatgtatggaggataactgcctatggcgaaaaataagaccaagattgaagtgacaaccgtatttgacggggaactggacgccaccgatgtgttcgtcagcctgatttcccagaaatacggcaaaacaaatacaaaagaatatcttgctaaaaagaaagatttgaagtataatgaagatgaggttcaacagagccagataccgtctggattgtgtgggtaaatggctatgatgaacgaaatggaatacagaacaatcggttcagcacttgccgggggctatcgtgcggcggtctattgcaggctgtcaaaggacgatgacctgcaaggcgaaagtgccagtatcgcaaaccagcgtgatatgctggaaaaatactgcgaaaagcagggatgggaggttgtggcagtctatcaggacgatggcttcacaggtcttaatatggagcgtcctgatttacagagaatgttgagagccattgagcgcaggcaaatcaaccttgtcatcacgaaagacctcagccgactggggcgtaactatttgcaaacagggcatttgattgaggactttttcccaagaaacggtgtccgctatatcgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttttccgttatcaaagaccttttgatgaatcccgtttacactggggcgattgcttcccagaaaaaggactaccgtttcaaaatcggcacgattggggaaaagaagccggaggactggattgtagtggaaggacagcatgaaccgctgattgaccgcatgagctttgacattgtgcagaacaagctgaaatcccgccagcgtccggggcagaccaatgaaatcagcctgtttgccggactgataaaatgcggcgagtgtgggaagtctctgacggtacgctacacaaacgcaaaacatccccagcagatttactcctgcaagacctacaatgcctttggaaagaaccactgcacccagcaccggattgattatgacaccctttacagtcatgtgctgcggaaaatcagggaatgtgccagagctgccctgatggacgggaaagcggttgccgaccgcctgactaatacctgtgaagccgagcagcgggaacagcgggaagcaatggaacgctcccttacaagggacgaggaacggattgaggttctggataaaatggtcatgcggctttatgaggatatgattgcagggcgtatcagtgagcagaatttcaacaccatgctggaaaagacacagaccgagcagacggagcttaaagcaaaagtgtccgagggcaggaagcggctgtccgatgaagcccagcttgccaatgacgcaaaacaatgggtggaagccattcaggaatatgccaacatcacagagctggacgcagccacccttaaccgcttaatcaaagaaatcgtcgtgcatgagcgcattgacgaagataaaacaagacacatttctatcgaaattcattttaatctcaaacccatcccagaggtggaacaggtcactgcctgacttgtcccgccgggacggttctcttaaaaacaccatatagattttttgtacgccgccgcccgccatcgagcagagttttacacctaattgggtatgaaacagctcatggccggaggcggtgttgtcctgattggcacacagcttatccccctcttatccggcctgttctaaagcgttcccattcaaaggagtgatatatggatactatcatcaatgcaatcgtggaatggctcaagggtgtgcttgtagatggtatcatgggaaatctggacggccttttcaacaacgtgaatgagcaggttggagggattgcctcgcaggttgggacgaccccggcggattttaacgccggggtcttttccatgatacggcagatatcggaaacggttgttctgccaatcgccgggattatcctcacgttcgtcatgacctatgagctcattcagatgctcatagaccggaacaacctccatgacatagacacatggatgttcttcaagtggatatttaaaaccttcgtggccgtgacgatcctgacgaacaccttcaatatcgtgctggctgtctttgatgtgagccagcatgtgatacagcagtcggcggggcttatccagagcggcacggaaatcacgccggacattatggacagcctgcgcacggacttggatgcgatggagctgggcccgctgttcgggctgttcctccagtcattcctcgtccagttcaccatgaccgccctgaatatcgtgatatttgtcattgtctatggccgcatgattgagatatacctgctgaccagccttgcccctatccccttctccaccgtggcgaaccgggaaaccgggcacatggggcagaactatttccggtcgctgtgcgcggtcggctttcaggggctcctgattatggtatgcgtggcaatctacgccgtgctgattcagagtatcgcaacggacggcgaccccatgggggccatctggcgctgtgtcggctacacggtgctcctgtgcttttccctctttaagaccgggagcctgtcaaaatccatcttcggcaccggttaaaccggcagaaggacttcgggccaccctggcccggggcgggaaggaggacatatgccgagacgttacaagctgggggcggacgggcaggcccacccgtcctactttggaaagctccccgaagaatttacaaaagaggataccctgcgtttcctcgcagacacggatatccagttgtacaggcttctgtcggcggacacacatgccgcactccgggcagaaagctatgaatataaggacgggggcctcgtccccatttcaggaaaggagacagttatgcaggaacagacaggcggcgcacccgccgctacacaggaacccatgaagctggacgtgagcgtgaggctcatcgaccccgtaaaaaacctgattggctttgccagtgtgaaattcaacgactgtttcgtggtggagaatttcaagattctgcaaggcgaaaaagggatttatgtgggtatgcccagccagccggacaggaacggaggataccgtgacgtagcaaaacccatcacgaaggagttccgcagccagcttaacgaggcggttgtggaagcctacacggcggagctcgaccatttgcaggcaaggttagccgccgcaaggggaggccaggaacgcccctccatcaaggaacagctcacagccggggtaaaacaggcggaacaggcgcaggcggaaaaacccgcaaaggcaaaagccagccgcgggcaggacagataacctcgggccatagtggcccgaagtgaaagaaggaggcgatacccatgacacacaggaaacaagcctatgacgccgcctgctactacgatggaaagctgttgggccgctgtaccgtggctgacagtgaagcctattcccttctgatgaaagagtgcggcggggaggccgtccgtgtcctgcgggaatatccctacttgtccccggagctgaaagccattctggaaaaagcggcgctcatgcaggccgaccgtcagaggacaggcggcatgttccatgagccggaaagctccccgtggggcaaggtacaagcctgcgacacgctatgccccggggtgttcctcgtgagcacggccagccacggcgggacaatggtggcaaaggaagtagccgccgtcctgtcccctgcggctaaaaaatgcggtttccagagaaacggctacatctgttttgaggaggacgcacaggaaagcgtggtactgcgggagctccttgataaaaagctgtggaaaatccctgaccgtatcaaggataaggaaaaattcgaggaaaacatcaaccagtccatcagacagtataaccccgactactggcgggcaaggcaggccggacgggcggccgccgtggaagggaaacggcccctgcccgcaaaggaggcggccagatagcttcgggccaccatggcccgaagcgccaaaggaggtgaacagcccgtggcatatgtacccgtaccaaaagacctaagcaaaatcaagacgaagctggctttaaacctgacgaagcgccagcttatctgtttctcactcgcggcggcggtggggattccgtcctacctgttcagccgtggaactattggaaacagcccggcccttttcctgatgattggcctcatgctcccgtttttctttttcgccatgtatgagcgtgacggcctgccgcttgaaaaggtgctgaggaatatcctgcgcacccggttcctttatccgagggtgcggccctatcagacagaaaatttttatgctctattgagcggtttcaagaaggaggcgaagccgattgcagaaccagaaaaaaagaaaaagccccgcaggaaaaaagcctgaccggaaaggcggcctgtttcccggcggaaagcggaaggttcccgccaccgcccagcagacccttccctaccgggaaatgtaccgggacggcgtgtgccgggtggacgaccattattatacgaaaactatagaatacgaggatatcaactaccagctcgcacaggccgaggatcaggccgccatttttgacggctggagcgcctgcttaaattactttgacagcacccttcccttccagctctcattcatcaaccaccggagccgcccggaaagccgctacagcgtcaacatctccatgcaggaggacgaatataacggggtacggcaggaatacgtggaaatgctggaaaaccagatagccaaaagtaacaacggaatcgtgcggacgaaactgctgacctttggcgtaaacgtggacgatttatccacggcccgggcgaggctggaacgggtggaggccgatatcatgaacaacttcaagaagctgggcgtaaaatccgccgccctctccggactggaacgtctggaactgcttcacggccagctccacccgggagggaatgaccccttccgtttttcatgggacatgataccgaaaaccgggctgtccacaatggattttatcgcgcccaccagtttcgacttccggttcagccgcctgttccgggtgggcgccacatggggagccgcctcctacttgcagattcttgcctcggagctatccgacaaactgctggcggagctgttggagctggacgcggaaatgactattaccctccatgtgcagacggtcgatcaggccgccgccgtgaaggccatcaaagccaaagtctctgatatcgacaagatgaaggtggaggaacaaaaaaaggcggtgcgttccggctacgacatggacattctgccgcccgaccttgtgacctacagccaggacgcaaagacccttctggaagatttgcagagccggaatgaaagaatgttccttttaacattccttgtggtaaacatggctcctacccggcgggagctggataacgacctgttcaccgtatcgggaatcgtacagaaatacaactgcgccctgaaacggctggacttccagcaggagcaggcgttcctttccagcttacccctcggccataactccattgagatacagaggggcctgaccaccagcagcaccgctattttcgttccctttatgacgcaggagctccgcatggacggggaagcggtctattatgggctgaacgctctttcccacaacgtcatcatggcgaaccgaaagaaactgaaaaaccccaacggcctgtttctcggagtgcccggttcggggaaatccttcgccgcaaaacgggagcttgtgaacgtgttcctcgccacccgcgaccggattatcgtggtagaccccatgggcgaatattccccgttaatccggcggctgggcgggcaggcaattgagattgcgccggacagcccgcaccacatcaaccccatggacatagatttgagctttgacgaggaaaaccccatggccttaaaagccgattttatcctgtctctgatggagctcattgtcggcggcaaggacggcctacagcccattgaccggacggtgattgaccgctgtgtacgcttcatgtaccgggagcatatccagcacccggaaaaggaacagatgccgaccttgcaggacttatacgaactgctctgcaaacagccggaggcggaggcttcccgtctggcaacctcccttgaaatctacgtgtccggttccttaaacgtatttaaccatgaaaccaatgtagacctaaaccgccgccttgtgtgcctcgacttaaaaaagctgggggcgggactgcgcacgattgccatgctcatcatgcaggatttggtgaactcgcaggtttccctaaacttcatgaacgggcttgccacatggtgttactttgacgaatttcacgtactgctccgggacgcgctctcggccagctactgcgttgccatttggaaaatgctgcggaagaaaggctgtgtcccgtcagccctgacccagaatgtgaaggtgcgcccagatagggcgctgtgcaaagcagtttaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgcaggtgtgggaaaagtcctgaaacccatgtcataacgctgtcacgtcatctttcacggcgggataactgccaacacgttatgaaacaggcgtgagaacacgtcacaacgaaccgaaagcatatccgacaatcttcactaacctatgcacagtgctaactggggattgcctaagtccggctcatttgccggatatggtaacggaggctccatagtagtccgagaggggtaatgacccttacatggcgaagggagccagttagtaacatctaaaatgtaagaatgaaagggaggagaaacctcaatgaaaccaacatctgaaattttagagcgtattgaaaagtgttccagcgaacacaaagacggcgtattcacaagactttacagatacttgcttcgtgaagatatttactacgccgcctatcagaaactttatgcaaacaaaggtgcaacaacacagggtatcgacgacgataccgcagacggtttcagtgacttctatataaaagagttaatccagtcactaaaggacggaacctacaaggctaatcctgtaaggcgtgagtatattccaaagaaaaatggaaaactccgtccgctgggtatcccgtctttccgtgacaagctcctgcaagaagttgtcagaatgattttggaagctatctatgaacctgtctttgacagtcattcccacggtttcagaccgggcaaaagctgtcataccgcactgcgtcagatttcttctgacttcacaggcgtggtctggtttatcgagggcgatatacaaggttgttttgataacatcaatcacgaaaaattgattgagattttgagcaggaaaatcaaggacagtcgttttctgaacatcattcgccagtttttgaaagctgggtatatcgagaattggaagtacaacgccacttacagcggttctccgcagggtggtatctgttccccgatacttgcaaatatctatctgaatgagctggacaagaagtttcgggaaatcgcagaactctttgataagccgaggtctgcatatcagacactggaatatcatgcggcaagcaaagaattaaaaagactgtcttactggattgaccatacctctgatgaagcggcaagacaagaactgattgaccagcatagggcgcagaagaaagctatgagaaatctgccctgcaaacctgccgacaacaagaagtttacttttgtccgttatgcggacgattggctggcaggcgtgtgtggcacaaaaacggaatgtgaggaattgaaagccgaaatcgctgaatttctaagcacagagctgaaattaactctgagcgaggaaaagacgctgataacgcacagctccgaaaaagtccgcttcattggctatgatatttgtgtccgcagaaatcaggaagtcaaaggtcacagaatgaaaaacggaacgtggagaaaatcccgtaccctgcacatgaaagttgccttgtctattccccatacggaaaagattgaaaaattcatgtttgcaaagaaagtcattcgccaaaaggaaaacggggagtttcagccgatacaccgagccggacttctcaaccttgcggattatgaaattgtggaacagtacaatgccgaagcaagagggttatgcaactattacaatctggcttgtgattatcacacgttggactacttctgctatctcatggagtacagttgcttaaaaacgattgctaataagcataaaaccagtatccgcaaaatcattcgccagtataaagacgggaaaacatggtctgttccttatgaaaccaaaacagggacaaagcgtgtgcgccccgttaaaatcgctgactgtaagcgtggcgaagcgagtgacatcatctatcagagaaagaaatttagctggaaaaccactatcagacagcggctcaatgccagagtttgtgaattatgtgggtgtaaagaagccgatttgtatgaggttcacgttatacggaacttaaacgaattgggtaattctgattgggaaaccgtgatgaaaaagaagcggagaaaaacgcttgtcgtttgcagcaagtgccatgaaagaatacacagacactaatcaatacgtcaattactaatggggagccggatactttgagaggagtaagtccggttccgagggagggtgtaggaaacctaccgccagcggcggcaaggcgcctttaccctaccctacgattttctggcaagtcccgaaattgaaaatattttcgagaactcggattttctcgtcctgcttgcacaggcccagggcgaccggcagattatcgcaaaacagctcggtatcagcccgcaccagctttcctatgtgacccacaccaattccggtgagggccttttgtttttcgggaacgtcacaatccccttcgtagaccacttcccgcaaaatacggagctctatgcaatcatgacaacccgcccggaggataagaagaatgagccaaaacaggaatgacaccacttcgggccagcatggcccgaagctcacggtgcgggaaatccccaaagagcgggccatcggctttatccaccgctaccattattccaaaatcatgccccggctgaataagcactatctgggcttttacactggaaaccggcttgcgggcgtggtggcgctgggctggggaacccagccgctccaaagcatacggaagatattcccccgccacaggctccaatccggcgactatatggaaataggtaagatgtgctttctccctgaaatgaacgggaaccagtattttgggagccgggtgctctcccagcttgtaaaatggctgaaaagcaatacggactgcctgttcctctacacactggcggacggcattatggggaaatgcggctatgtgtatcaagccgcgaacttccggtatattgggagctttcccaccagcgtctaccgctgtacggccaccggggagaaaatccacccacggagcgcaaggatcttactggaagaaaacgccgcccttgacggagtggaaagacggttctggctgacccatggctactgtgaatacaaggggattgaaaaaatcaacggcctcatgttccgttacctctacccactgaacaaggaggcggaaagaatcctgaacgcttacccggagtaccaagggctcccaaccccgaaggataaggatttaagatttaccatgcgcaccgccccgggggtatataccccagtcccgccgccagtatttaaccgtgatgtatgccagttcaacacacagaaatgttgaggctggcttttttatgttccgggaaaggaggaataacctatcggaaaggaaccaaagaaaggcaagcccaaacagccgccgccagataccttcacctcgggccaacatggctcgaagcaggaaaccaaccagccgccggattccgccccttccggccgcctgcgttttgaggaagaggacacgccgccgcaggccggagccacctcgggccagcatggcccgaagccctccgggaagttccggcaggatacggaacgggcccgcccctccgaccatatgcggcgggaggaaaaagcggacggagacggagggcaggaaccccatgacaaagaggccgggcctgaccgggccggtaataaacgggctaaaggtgagaaacgtactgacggcaagaaatgctctgacggcaggaaaccggacaagacggagaaggcacaggaaaaagcggataagaccgaacagaaactggaatcggcccgggagaagctggctgcgcagaaaccgcccaaacagccgggactggcaaagaaagctgtccggggtgtgcgggcggaggtatggttttacgcccacaacaagatacacgaagtcgagcatgaaaacgtaggcgtggaaggagcccataaatccgagcttgtgaccgaagcgggaacccgtaagctcgtccgttttgccagacgccgctaccgtgagcacccggcccgccgggtggcgaaatgggaacggaaggaactggcggcacgggcgaatctggattttcagaagatcgcaaaggaacacccggagcttaccagcaacccactctcccgcatggcccagaaatggaaactgaaacgccagtatgccagacaggcaaggcaggccgcaaaacaggggacacgggcggcgaagaaaacagccgccacagccggaacccttacaaaacgggcggttcaggcggcggcccgccacccggtatttgtcctgattatcgtggtactgttcctgctgttttatatattgtcggcgttttcctcctttatccccatgctggggagcagccttgcaaacgccatatccggcacctcctacgcctccgctgacagcgaccttttaggggcggacgaggactatgccgctctggaaaatgacctgaaacagaagattgccaatatcgagcacacccacagcggctatgacgaataccgctacaacgtagacgaaatcggccacaacccctatgagctggcctcctacctgtcagccaaataccacagctatacccggtcaggaatacagggcgaacttggggaggtctttgaagcacagtacgaactgacgctgaccgaggaagtggaaatccgctaccgcacggaaaccagcacggacacggacggcaacgagacaagcgaggaagtcccttatgaatactatatcctccatgtgaccctaaaaaatcgcaccctccccgccgtggtgaatacccggcttaccatggagcagaaggagatttattccgtcatgcaggaattaaagggcaataagccccacctgtgggaaggcatttacacgggaggcggcacaggaacggaacccggctaccagatacccggggaagccctgtccgacccgtcctttgcgaccctgattggggaggcggagaaatacctcggctatccctatgtatggggaggttccagcccgtccacctcctttgactgctccggcttcgtctgctgggtattttccaacagcggcgtccacaacctgccccgtaccacggcgcagggcatttacaaccagtgcgcccgtgtctcccccgctgacgcaaagcccggggatatcatcttttttactggcacctatgacagcggcgtgccagtctcccacgtaggcatttatgtaggcaacaatatgatgatccactgtgggaacccaatccaatacgccagtatcagcacgtcctactggacgcagcatttctacgcatttggccgtttatcaggaaattgaccgtcacgaacagaaaggagattcgcatgaacagacttgaaaaaatcgaaaaggatttggagaaagcccgggagaaggccgccgagtgccaggccaaagtccgggaactggaaaagcagaaacaggaggaagaaaacagccagatcgtgcaggcggttcgctccatgaagctgacccccgccgagcttctggccttttttaacgacccgaaggacacacctgccgcttcgggccagagtggcccgaagtccactgacagaaaagaaaaggaggacgaagcccatgaagaagcctaaccttacccgattggcggcgctggccgcctgcctgctgtgcggtacttattttacaatccccgcctacgcccagagcagtgaaccgcaggccgaaaccacaccggctgaaaccgaagccccggaggaaccggcggagcccaaccccttcaccccggacggaaccggaaccgtggtggataaggccaccgacaaggacgggaaggaattttacaccatcaccaccccggacgaaaatatcttctttctggtgattgataaccagaagtccagtgaaaatgtatattttctgaacgctgtcacggaaacagacctccttccccttgcggaaaaagacagcgaaggggaggctgtgaaaccgcaaaccacacccacgccgggaacggaaccggaaacgcccacagagaaaccggaacagccggagcccgcgcccaaagaagataaggcagacaacggcctgttctccctccttctggttgcggcggtagtcctggctggcggcggggccggatattacttaaaaatctataagcccaaacatcaggccccggacttggaggacgattactgcgagtatgaggaagaagccgaggaaccggaggaatccgaagaagatgataccccgccgtgggacgaggaagaacccgaggcagacgtggagaaaaaggaggacacggaatgaatttcacagacagcccttttgaacagatgatgaaggaggctccccggccgggcagggacagttccggcccctgcgccgggtgccgttatgccaaagagtgcaagaaccagaaaggacgctgccgtaagaaattccgtgccctgcttatggagccgcaggcttcgggccaatgtggcccgaagtcctgatgtcccgggagctgacccgtgacgagaggaagaaaatccgagggcttgtcacgggtatgtgcgccaattatgacagtgaaaccggcctgtgtctcccgctggattgtccctgctatatgctgaataaatggtggacaggcgcttactgccgctacttccggcccttcgtcctgcccctcaatccggtgttggaaaccgccttatcggaggaagggcccgtccccgggctccggccctgcacggtctgcggcaggccctttttgccgatgggacggcaagcctactgctccgaagcctgcaaagccgaggggaaccgcaaaaagagccgggaacgtatgcggaaaatgagaagaaaaacggagggccactgttacgttttgccctccgggaaagcctgattttgcaggatttctaagaggcagaaccggggccgtgataatttcatacctccgtccccggttctgccgtttatttcgtaacatcaccagacttcgggccatgctggcccgaggccggaaaggagaatctgcatggaaaatttaaaagggtatcaaatccagaaggaggccgtctttgagaatggccgtggcttcgcgctggcccataacccggaggcacagtcaccgtttggaatctggcatttcacggttatgccggaaggggaacgcaactactatggctttacggcctgctgtggtatcctgccgccggaaaaagagtttgagaagttcctgtccgcctatgactatgtttacaaggttcctcaaatggcggagggacaaagaccgatggtaacggactattaccggtattacacccactatccccttgacaataacacgtttccaaaatcaaaggagctggggctaatagagattgccccttacgataaacagacattggtggaaggcaatttcatacggacgtggggggagctgatttatacaaagccgctgccagagaagctggtgaaagattatgacttgaagccctcccgcctgaatcctgacgtgaggaagaaaatggaggaacagacgcagacgctgggcaagtgggaggacagccgccatttcggcaatcagcggcggctgacatggtttcatcgggattttggaacctatatcctaaaacagccccttaccccggaacagcttgctggacggatagaggtcatggatgaattagaggcggagcggaaagaaaaacggtcgattaccgccatgctccgcaaagagacgaaacaggggaaggaaaactgggagccacccgccaaaaagggcggtcccttccacgaggacagataggaggataaaccatgcacgaaaaagataattaccttaaaaatgcagaactttccacagagcagaactgcaacatgattgacgggattcccaacaatacgccgctccctccggctcccccggaatcggacaaaaagccacttgataaagtaaaggaaccgccctcccgcaaactgagccgggaacgtgaggacagatgaaaggccgtaggcgtgatatacaccttcatgtgatggtgactgcggaggaactggcgggaatccgggaacgcatggacgaggccggtatcaccaacgccggggcctatatgcgcaaaatggccttaaacggctatatcctccatgttgacttatctcccgtaaaggagctggtttccctacagcggcggtgtgcgaacaatctcaatcaggtagctgtccatgccaacatgtacggcatctacccagaggaaatcgccgggctccagcgtgattatgaaaagctctggggacaggtttccaatgtactgaaagagctttccgaactggtggcaaagtaaaacggcaaggggataattaattccccttgccatatatatatgttattactatcttctctttttggttgagctttgttccggtttctgaaccctccatttatagtctgagtgggaataatatttagaacgaaagagttccattgatttttgatactgactaagtatcaaaacaacatcactattagttggaagttcttcattgtctaatgtatctaaaaaattgtaggttggttcatttttcaacaattcttttattggttctaaaatcctatttaccgctttaaccttataagcatttaatggagattcaggcttcttctttgataattcttgtatttcaaggtaagtcgctctaagcaaagggagcagtaaatcatattggtcaccttcttgctgtgttatatagttgtccacttacgtatacctcctataaatataattcagttggaggactagacgtttcaatttgttccttgctgccctccaaacgccagtaccaatgtccagttgaacgataaatattatcaaatttatatttttctaaacatttaatatattgtgataaaataaaaactacatcgctattagttgacatatcatcttcatcaaacaattcaaaatccgtaaatggtgcgtactctgtccccaaaatttgattagcaataagaattatttggtttacaaactttagtttaaatttattaatagaaccatcaggtgctttcttagataaaatacataattctgaatagattccttttatttgcgtatatagcttttcaaatatttcgatattttctaatttcattagcaacctccttttaagctggacacattcttataaattctacatattttttatttattacttccatcggatctcgctgttttgattcaaaaacattaaccatcatacgaacatcttcatcagttaaacaaataatgcattttctttgtcctgcccataagtcaatagtattttttaaaatattctttttaggtgcatttcgcgttaaaataataccgaaacgcccaaattgttctgcgagatacctatttaattgattaatatgatctctggataattcatttacatttttcatttcaaatacaatttgtctacacgcataatttttatacaaatcttctaataaaggaaatgaacaattattataaaaaatcaaatctctaatttgcgttcctgattctattctgctttgtgattgggcaaaatctaaatgcggatatagtaaagaagccattaacttagtgcaataattttcatatttcatatccgcattgtctgttttcccagtcggcaattttaatataccattcaaacatttttttgccgatactattggaatttgtttgaacaacggatcatttttacaatctgcctgatttcgctcctttaacgaaatataagaagaaaccatatcataattcagccgattatattttaaaacttggactttttcatttaataaatcatcatcttgcttaatatacgccttatcaaaatattcatcataatttatccagggtgaatatcttaaccaccttttaggaatcaaaattattggtgtattagtttctggattgtatggaagttctattgtttcgatattttgtttatatgttttaatattatataccgattgattatcaaaaggtttcatcggtatcccatatttatcacactcatcttgggtaaaatcaacaaggaaagactttaaaaaattacatgcaatatcactcaccctatccttagagatgttattaacaaataattgtatttcctcaaaatgtgtaaaaccatacgcttgaacttgtggaatggtcttaaaaagggataaaatttcattagcagtcttagccgaaattttcaatcctttttttgtatgtccactccctaaaccagcttcgctacattctgatagagaaattaaaatttgtactgcctcatcaatacgatcctttttaaccaaaaagccaaagtaattaaaagaatttaacaaagacatatgtagtgcattatcttgttgtgacggtgacttccacagtagaaaagggtcaagataaagtggaatatcttcatccaaaaaaggaatagcaaaaggtacttcctcttgcgttacaggtatattaaaataatcaaccaatctaggtttaataattgccattgtttgttccccctactgaatgaattatatcataatactgttcattattaaaggtggttttccattatctgcttcgggccacactggcccgaagtcccgggacaggattcgctaatcattcgcaacattcctgtcccaggaccgccatggtaaaatataagtagaaagaataaaaggaggcgttttcaatgagattactgctaaagctgtttgccgcacccgtcatgctggctctgacgctgcttgcggccatgatgatgttcctgtttgatatctgttcatttcttctgacggtggcttctgtcataacggcactgctgggtatcgggcttttctttacgcccaccccacacggcgggttcctcttcctgtttctggcctttctgctttccccctatggattgcaggcggttgccggacttctgattgaggcggtggacgggctgggcagttccctccgcaggtttctcgtaagctgatactacttcgggccacactggcccgaggccaacgatggcggcggctcgaaagagccgctgttctatttgggaaggaggtggctttctggctactaccactcttttgaagcgtcacgccaatgaaggagaaaccatagccgaagcaatccgtgactgcgttgattatgggaaaaatccagaaaagacggagaacgggaaatacatttcctcatacgaatgtgacccggccacagtggccgccgagtttcttctggcgaaggccagctataaggccatcacaggccgggagcagaaaaaggaggacgatatcctatgttatcagatacgccagtccttcctccccggcgagattacgccgaaggaggcgaaccgtatcgggtacgaactggctatgcactggacaaaaggccaccatgcctttatcgtcaccacccatacggacaagaaacatattcactgtcacatttattacaattcaacgaccctcgactgcacccggaaattccgcaatttctggggctcgtcctttgccctgcgcaggctctccgaccggctgtgtctggaaaacggactgtccattgtggagaatccgaagcttcggagcaaagggaattataagaactacggcgaatggctccagaacagggataggccgcttaactttcaggataaactgcggctggcaatcgacacggcgctggcaaaacgccccggcgatctggcggccttcctctcccttatggaacaggctggctatgaagtcaagaaggtcagaggcggcggcctgtctttccggctggccggacaggggcaggaacggtttacccgtctgcgggcctccactctgggggaaggatacgacttaaaagatatactggccgtcataaacgggaggcgggaacactccggccaaagcccccgcaaggtcaatctgctggtggatattcaggcaaagctggccgagggaaaagggccgggctatgagcgctgggccaaagtattcaacttaaagcagatggccgccgcactcgcctatttgcagaataacggcctgacggaatacgaggaattggagaaaaaggctgccgaaacaacagaccgtttccacgtgctctctgaccggataaagcagacagagaacgccatgaatatcaaccgggaactgaaatcggccacggtacagtacgcccgcacacagcctgtctttgagaaatacaaagcggcgaaatacagccggaaattccttgcggcgcatgaggcggacattgaactttaccgggcggcacaggctgacttgaagcgtctgcttaacggggagaagctcccgaagatggacgtactaaaggaggaaggccgaaggctggcggagcagaaatggaagctctatgcagagtaccaaaaagtacggcgggatatgcaggaagtcaacacagcaaaagctaacattgattatctgctgggctatgccgggcaggataaaaagaaagaacaggagcgatagagacggtaagaataagggacaaagtgacgcgaccacttcgggccagcatggcccgaggttccgggtttggggcgggccccaacaagcctccttcgtgccatttgtggccacgaaggaattgcttgccatttagcgacttacaaaatgtttatccaattatacatttcatcataaaggcttagaaacatttatatggtgatttacaatatcttaaaacacaaacggagtggaattgatattataaatttatctatcccactctgtttatgattttatgattatagagttatattaatacgttttctccatttgaatttctgtgtttcaaaaacaatccttcctgtgtaactaatctctgtaatacttgaagcacttcagtcgttaattggtaaaaagaaactgtaaatcctccgtcaatactcattagaaattgaggattagaaaaaagtatttgtatcgaagaaaaatcccttgatattacattctttattacatatgctaatttgtcaggcgagctatctctgatatttatatcaaaaaaaagttcacatttcacatcagcaggtattgaagattcagtcataaaaatctcacaagggtaaaaataaatcaactttaatgcaatacaagataccttctctgcatatataggaagataagttttttcaaagtaattctctaattccagaaaacgtacatctgatgtttcatatggaatatagtcaatatagtaatagtcatctgatttttgaagaaattctattatttcatacataataactaaccctcatcactttgcaagaacttctccattttctcctaatgaagcaactcgattccctgctttgtcttttaatttccactttcgacctccatgtcccgctgtatctttatcaattgtccaaccgcctttttccttataagaattttttccacctactttttcattaaattttcctaaatctacatctccattttcttttcttaatctggagggaattttagctcttatcttagctattgtacgagcttgagaattgcttagccattctgtaatggtattatacagccatgtacctgccactaccgctacaccagcgactacaatggctccagttgccgcaattgcaacctctccaatgcctgggataaaatatactcctgccgcaattggacttcgtgtttggatgccattatcttctgaattactaacttcaacagcctgattgagtaaatttgtaaattccgccttggtatagtatacaccattaatagtaacaccgttttctgttattataacacttccagaaggtgcattttcactttgtatagcagtactatcgtaattattttgagcaaatgcagagatatttgtgtttatagccattaacgctgcaagcaggatagctacgtgcttttttaagctatattttttcatatgtttacctccatattttaaacatgattttgtgaactatttgtggaaactataaatatattataatatcattataatgtttaactctcatgccatacataaacaccatatacagattttgttttaataaattttccgatcggaacagttaagtatttcgggttatatgttacaacatttgtactctttaccacaatttcatcctttgataaaccgccacgtggtatataatatttttgcaccttcccctttgattcgtccatgattggaatgaaagttacccaaacagttttcctgggttttacgtttatagtaaaagaatctgttttactataactttttccccaagaaccacctaatttagctttaatagcatctttatatttgccttcaacagaaggagaaacagaccaactttgagaaacacttaaacttaattgatagaattgttgagaagatgaatcatttcttattttatttgtcactgttttttccaattcagtacgctcaacatttttcctattgctagactcacgataacgatacttataatgaaaggggcctcgtgtctctgcctctgattttaccccttcgccagaatactctgactcaagtatagattctcgctgcttcccctcacgaacagccctctcataccattcttgtgcctctttgccttcaagtgtcgtaaatgtaccatcctcatttggaatactaatatatgtcactgttccgctacgatcaactggttcaccaccaatattttctgccgcaaaagttggtatagtaagtaaacataccccaaatatcgcccaaaataaacaagctagaattttctttattttgattgagattccaagacaattaattgttcccataaaatacctcctaaaaataagccaagcatggcacagcataaacttatctaaaaaattggaaattgcgtatatcaatatcttgtgttcgatatttaatcagaaatactttttcactctctcccaactcaatacgttctaatggcgttgggattggcaatttatcaggtataagactacttccgtcatcattaataagagataattgtaacacttctaatgccatttctattccttctttatcatttctggcacaagtattggcttccgggatatctggaaatgtaattgctatcccatacctctcttcatggttgtcatattcattgtaattaaatactgcataatactcaatatccatataaatcctcctaattagtccaacctgactccaaatacttcttaagatgccaataggaatttcagaattaggaccatgattaggaacagttacagtcctattacccttttccatttttgatgagttcctgattaacttgtcttttttaatccttcttttttcagtcgtttgtaatcgtttttaactttattgccagttgacttttttcactcatctttttttatctctctttgtcatgttttgataaaccttattgataaaccactactttcttaattcgcattctatttctcggcttttggctgtccctttcatcaggaaaatttcatcaatcttgttgctatcaatataaacatcttatttccaattgtcaaaataggtttggcaataaaatagccatatttaactttacggccgttatacatttcacgtactacccataaagatgatgaagcagttacatttaatcccaatataaagggctgatttgttttcccttttatttttacataaatcttttaagcataaattaccttacctatatgaccaactattaaagacacattagattcacctccctcaatacattactttaaatactaatatattatttataatacataataagtatattctgtacgatgtaagttgtcaagagctttggaaaataatgcaattttattattgacacagtattattaataatgtatcattaataatatattatacaaatatggtattggaggattatgatacatgcctaaaaggactaatgaactttcattaactcaacgagaaatggacgtaatgacaatattgtggaaaagcgagacaccactggtagcttcggaaattgccaatagcaatagttcattaaatattaatacggttcaagctgttataagaaaattgttaaacaaaaaatatattgttgttgcagacattgtttatagcggtaccgtcttaacacgtagttataaacctgctatttctaaaaaagaaatggcatttcaacaattcacaagaaatttacgagaagaaaacgagaatatttctatacccaatttagttactactttactgaaacatgaaaaaaacgagaaaaaagttattgaggagttagaaaagttgctagaggaaagaaagaaactacttgagcaagaggaaaaatagcatggttctgtcaatagcttcattaattacaataatggttatttgcgatttatcaattttagcattatctttttatttaaataaatacgaacgaatacagcaaataggagtaaatggagcgctcataggcattttattattacatttgcggttactcataccatttgaatttccatttcaatatacaatagctgaaaaattagttttacctagtgtatttacgattctttattttccgatttttaaatttcatacgtattatctatacatacaccatatctttttgttggtttggttattaggagctatgataattggaattagaactatctttatttatgtgaaatttaaaaaagcacttcaaacaaatttggaaagtgacaatacattcataaaagatattattacatcattggaaaaaccttatggaaaaatatcaaatttttccgtaatcaagtccgacttgattacagctccactactttttggaatatttaaaccatatattgtgttacctaacatagaattatctgaaagagacttatattatatactcaagcatgaaattactcattactattatcatgatttatggataaaatgttttgttgaagtaattgctattatttattggtggaatccattaatatatatattgaaacaacaaattgataaaattcttgaaatacgagttgatttagctattacaaagcagctagatgaatcaaaaaagattcattatttggaatgccttttgtttattgctaaagaaaacactacatcaaaagtcaattactttgtattgacttttaatagtgaatcagcttctgttctggctcaaagatttcatatcgtattagatgataatcctagaaaaaagtcacctgcaaaaaatctaatagtattattaattagtgcattaatactggcattaatctccgttgttgtattagaaccatactctatatcttatatagatcagcaacaaacggtagaattaaccactgaaacttcctttttggtgataaacccaaatgggggatatgatatttacttaaatggggattattttggcacggtatcagaaataaaagattcttattccaatttacacatatttaaaaatgcaaaggaggggttttcttatgaaaacaaaaagtaaaagaataatcttgtcattaacgactttagtattgaatttatctgtgtttacaacaatttcgtctgctcaagttacgacttcccaacccttatctatcaatgaaaattttgtagagaataaaacacaagattctactataacatttgctcaaattattggttggcgatataaaagtgaaaatggaaaggtatatagacgtcaatataattactcaaggaaaaaatggattggagaatgggaattatgctaaaatcatattactggatatgtcttttttacagaaatgaaaaagccggaatacattagcagagaagcgattgtatattcttttctataatatggataagaggcatttatatctgtcatggttccaaccctggtacttccccaaacaacaggtaagattgattttttcaaatgtaaaatccccatgttctctatacttccaatgtattatttttgacctttgccgcctttttcagggcggcttttgtgtttttccttgtcctttgtttgcaggctattcttgcatagaggacttttctccatggtggatagcctttcgatatgtttttttatattcgcagtatcaaagtgctctcttttatattgttcatcccaaagtatcgctggttttcggtaacaaacaatatttaggaggtatctccgtgactatttttataccttatagtccctataattttaatccacaaaaaattaactactttacatccaggtattcttaactataggtacgataaatatcatatcttatcacaaaagattttttgcgtccgtgcggcttcacaccctctgggcgcttttatgtttttacgtaaaacgctcaagtcaacatggcccgaagcacagcccctatgtcgatctccgccgtcctctatttcggttactcattcacccaacatcgaaatggaggacatcatgactattataaatctccgggactattacccgttttataccagcgacaattttattgacgtacctgacgaggtgtatgaactgctcaaagaatttgaccgcaaggaggccgcctatcgtctacgtacttaccgtcacaaagcctactactcccttgaccgaaatgacggaatcgagcatgaagcgcttttcgtgtctccctccccctatgaactgtatgaacgcaaaatttccatacaggagcttcataccgccatatccaatctgccggataaacaggcaaaacgtgtctatgcccatttcattctaggcatgagccaggcggatattgcaaaggtcgaaggtgtcagcaaaatggcagtatgctattccattgaaaaggctttaaagtctatgagaaaatttttaaaaaattctctagattgactttacagagaagcgatttttgaactggcttatgagaggcaaacaaccacgggtcaatatggcccgaagaaaagtacgccttgactgcaatttaaaaactgaataaaaagataccggatacgaagggttgatgtgtccagtggcaggcccgccatgacccccattgtcagagaatggggagagcgaaaaggctcatgccgcaggcaggccgtggctggttagccggataaaacacaaagaccttgatacttgcgtttagtcacagtccgagcgtgaagcggccttgcaagccgtgagccgtcacaggcaatgagaacgccttgccatcagaatggggagagttgaaatactatggggtgaacatgcctacacccatccgggaatctaataagtaacatcatatcatggggagtcgcccgacctcactgtcttgtaacaggccaaatattccggctcggctcccttgtttttcaagaaggagtttttctataggaaaaacatttgaggaaattcaggctatggctgtagacccatggagtaatgatgcctgtcgtggctacgttatctggacaatggaaaactccggattcaagccaaaagaaataacgcaggctgtaaccgagctatatacggcatttgacttccagaccattgaagaagtggccaggcattattataatagttcttttttacttcgggtcaagttgtcccgaagttttacttttgcccatttcaaatttcatttataggataagcctcaaactgcatatgatatagcaagcatatatagaggtgattgttataaaaaaaggaaaagaaatctgttacttacttcaaaaggctgacactgacagtaatgaaattgccgaaaaaaagaaacgtctgataaaacaggggtatcttgttgtaaccattatcgaggggaaggaaaacatggaaaaggggttgcgtgagattgtgaagaaccattttcactaattattcgcaacattgtgttatttcccctatatagtacaatatagatataacgataaggaggacgatattatgatctcaacattaacagatacccctcaaattatagacggctatgttcggctttccagagacgataataagcggaactactcgtctattgaaaaccagaaaaagattatccaacaatatgcagaagaaaataacatgataatccgccacatttatgaagatgatggcatttccggctattcattcaacagacccgattttcaaaaaatgatggctagtcttgatacgattaacgtcattgttgcaaaggacttatcccgtatcggcagacacaatgcgaaggtactgctctttcttgaagaaatggaggaaatgggaaaacgcgttattctgattgatgataattatgattccttttactctgatgatgatataataggcattaaaacatgggataatgaacgtcatgtaaaaaatacaagtcggaaggtaaaacgtatcaaacgcatggaacaggaaagcggaactcttgtcagtcagacgccatttggctataccagacaccctcttaataagcagataattttgattgatgaagaagccgccgctatccttaatctggaaaaagaaatttatctggacggtaacggaatccgaaaaacggcggaaatactcaccgaacgcggtgttcctacccccagcatgatagataaagaacgccatgaatcgttaggtcttgtctataataagaaggttgcctatcagtggagtttcggaatggtaaaggacactttatttaatgactataacaacggcgttctcagaacccacaagagagagcgtgttacaataaacggaaaagataaaaaggttcctaaagaaaatcagtatatatttccgaatcatcaccctaaaatctttgatgatgataccatgaagctgttaaatgaagtcaaagacagccgccaccacagccagtacagaggccaaagagcccatataaaccttttttccggctgtctgtactgtaaagattgcggaatgaaactgacagcaattaaccgccctaaccgcgggaaatattacttgtgcggtacatacaataagaaaggaaagcagttctgccggtatgcccatttagttacagaagaaacattgatggacgctcttgttaaatatctggttctctgccgtgacagtttggcaaatattatccagaattttgatttgtcaaagttaaaggtggaaacttacactcccactgacagtaaacagcgtttagaggccgaacttgaaaaggtaaaggaagaactcaagattcttataacacaaaaggtcaaggagataacagccaatccctccatgaatgagattatcactgaaacctatgcagcccttcaaagtgataaaatggaacgcatttccgctattgaaaaaaccttgcaggatttgacaaaggagccgcatataccctccaccacaattaaacccagcttacagacagcgttggacattatgaacgaggttcttgagaagaaagaattaagccgaaaagatattgaggttctggttgagaaaatcatagtggataaggacggcaacattgatatatatctcaaacacggccttggcaatcttgcctcctatgatttcagagcggacaaagaaaatctgaaactgactatgctcattgaatctatccggcttctagaaaaggacgaaacaggttttacctcggtaaaattccttgccgacagcctgaaagagatgggctatcccatgcacaagaagaaatttgtgacttacatggagcacttacttgacttagggctggttgagaaaacagggatctaccactatccctatagaatcgtggcctctcgacagcaactgcgcgatgtggaaaaaatgttcatcgtggtagggcagacaggcggtatgccggaaatgatcttcgaatacatcttaaaaaagaacggcattgacccgaaaaccgatctgaccatcgaccagagcatcaatttcggcttaaccgcagccgcattcaccagcaacgacgctgattacactgtggaatttgaaccatttgccacagggcttgaaaaagaaggcagcggaacggtagtggcctctctgggcgttgattccggatatgttccctatactgcctacagtgcaaaaaagagctatctggaaaaaaatcctgaaataatccagaaattcaccaatgccatccagcgcggacttgagtacgtgaacacacattccgcagaggaaattgcagagacaataaaaccgcagtttaaggaaaccgacactgccacgattgcaacgattatagaacgctacaaggagcaggacacctggaaaaacgatacggttttcgagaaggaaagcttcgaacttctggaaaacatcctggaagaagcaggagaactgaaaaagcgcgttccttatgaggatcttgttacaaccgccttctcagaggaagcggcaaaataaaccgtcatccagctgctttcatctgttttccaacagtaaatgccgcaaaggccctaacggaatgtttcactccggttacagggcctttgcggcatatttttgaggacggcggcctgcgccactttcttttactcgtataccaccatttttcctagcgattcttccaaattaattacagccacgattttatcttccccttcaaatatcttcccgaccgtcagcacactgctgttcttgtcaggcaattctccttccacctgcctgtctgaaaagacattcagaatctgcggctccgtctcaatcagaaaaccgcattccagtccggctgcctttgtgaccaggattaatgcctgcatcacattatctttatcctgaagaggagcaagaccgccggcgcgcctcaatgagacaatggggatgatatttcccttccagttgcatacgccttcataatattcaggcagacagggaacctttgtaacgcgcaaatcgcggaccagttctttaacgttatccagttcaaagccaaaacagaagctccccatatcaattcccataaattccaatttatcccggcggctctcctcctgcctggattcttcatcaaaaaagagttcactgtcaaaaccggacgtcttttcgtccatactgcttccatcactcatacgtcttcatacctcctgccatccggatcaaatcttcgatatcaagctgcatgcagattgagccgtcgccgagaatgctgcaccccgaaattcccgtataatatctgaaatgggggccaaacagaggcggaagaggtttttccacaaggctcacctgatctaatactttatcagcgaggatacaggcctcccgtgtacttcccctcacataggccattaccctgcgtcccgtctttttcccgtcctccatctcataaaaacggcgcagggatatgacgggaatatagcgtccctcatgaagccagaattctttccctccctgcagaatccgttctgcctccctggggggatacggaaaaaactgtattacctgatgggccggaagggcaaaatagttttccccggccagcagccggatactgtcaattatcgtcagagtcagaggaagatggagggtaaaccggcttccctctccctttttactttccagatgcagatgtccgccgaactgttcgaccatctgccggacaacgtcaaggccaacgcctcttcccgaatattcgtttgccgattccctggttgaaaaaccaggcagcaggcacagttccagcagctctgtctcggtatactcatcttcatttccggtaaaaagcttcttatctctggctttctgtaaaaccttatccgtatcaattccgcagccgtcatcctccacagatatctgtatctctccgccggtattttcgaagttcaggcatatccggccggttctgttctttcccgccgtctcccgctcagaaggagtctcaattccatggtctatcgcattgcgtatcagatgaagcagcggctcaagaatattgtctgcaatcttcttatccacctccacctcctggccggtcaccgaaaaagatatttcttttccttccttccggctcatgtccctcacgatacggttaatctgagggacaacaccggaaaacggcaccatgcgtatcgatattacaagttcttccagatcctttaacaggcgttccagctggcgtcccgtattttcatctttcacgctcttcccgccgttatgcgcagcagccgcctgagcagctatcatcagttcccctgtgagattctgcaattcatcgaggcgttcgaccttcacataaataaagtcactgcctgcgccggttgctgctctttttcattcttttggtgcggtaattcaccggccgtaccaaccgattccacaaagagggattgtctcagtttttcgaaaacacggtccgggtcctcagactgaaaacggataaaaaagccgttttccctgatatactccgacgtctttggctctgtctccacatgctccggataggtctgtatttcgctgcattcttccgcaatctggcgcaccgtcatataggcgcgcatattttccatcctgcagtccttttcaaacttcacgcggacaacaaaggtcttattctcttttgcccttgcaacaagctcatctatctttttatcgaaaccgaccggctccaggggctgatacgtctcctgattcatccgggccagttcacttcggatgaaatcaccggcgtcaaaaatcaaatcaaaggtttcctgctcaaggcctctgagtctggacggattctccctgaacgcgtcgaagacatcctccagccggtgcgccagaaccgacagcgccgtcagtcccatcatggccgacgagctctttatcgtgtgcatgacccggaagattccattgatatgctccttcgaaagagacttctccttctccgcatttaacaggatttcatccgcctgttcaaggagctggttcgtctcgagaagatatatatccagcatatcttccatatccgcatcaaaatatcccatcggcatcactctcctgtttcattctctgacccatacattacaacccggttcttgccggaagtcttccccagatacagcgccttatcggcacagactatgttctcgtcaaaagacttctgcttatcgtacatctcaactcccagagttaccgtgcaggaaaaatccacatcgccgcacataaaaggaaaggcggatatctctctgcggatttcttcacagatttcaagcaccccgcgtttcgtgacagccatcagtacgagaagaaattcttctccgccccagcgtatcaccttatgccttctgcaaatactttccatgatattggctataccgacaaggaccatatctcctaccgaatggccataggtgtcattaatgtgtttaaagttatccacatccgccatcaccagggcgtcctcccgaccctcttccattaaatcctgagccagcttttccaccacaaaacggcggttgtaaaggcttgtaagttcatccctgaatactgccctgttcagcttttccatattagcccggagcgtttcattcatggaacgacatccagcaatatcaaatcaggctgcagctcttccagcttctcgagcgcagttttagccgtataggccttatggatctccagctcatcactttttaataccttctcaatctgttggcaaatctgcaaactgtcatcaattgctaaaattgtctgcctgcttttcatatgcttctctccttccattcggacatctttcccgtcaaatcacatatattccatatctgactgatttcaccgtgacctctccggtttccgaatttaaaattacggttctcccgtagtcctttcccgtatcctccgcgataatcctgatgcccaaaagcttaagctcctccctgactgcagtgacgttacgggctccgattccttctgaagtgttggaggtcgtaaacattctggctccgccggccagctttgccgttatgtattcccggccggccccgcacgccgtcattgctctgagaagctcttcacagcctctgtctgcgaatttatagggattctgccggtcgattgcatcctcctgatgcggcagcagaatatgtgccatacccgcaatataattctttctgtcaaacagacagatactgacgcaggagccgagcgcatacgtgatcagctcccttggccgttttgcgacgccggcttgggctattccaactataaccggactatttttcatattcctctcccaacgccctgaaaatctgctcaagagactctatctccggcagaaacagaacgtgactgattacggataaatccccaaagtgatatttgtcttcaatcagaagcagttcatcactgatattggcaaaatgaatcatcggaacacttaaaatagcgcctatcatatcaacacaggtatccggcactgagacatcaacctttatgtccagcatcctcgtcagcgcattgatataagaacagcacatgatattgcctatctcactgactgccgacatactcatcggatccaggcaggtgatatcctccacctccattcccagcaatccctccagcatgaccttcagaaaaggcgcgctgcttaaaaacataaagattccgcggatatcgcccgtgatttccagcaatactccgaccctgacctcttcaatcccgccaagcatcccgggtacctcattaaattccattatcctcacatccgggcattccatatcaatcagccggtccagcatttgggacaggggttaccgcatttccggtgcctatgtttccaatctccatcaggatgccgcgggcattttcgtttaactccgaatatctattcatttgtttccctccgctccggctggggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactaccccggctggtttttcagatggaaaggccctcctgactgctgcggtaatctgttccggtttgaaaggcttgacaataaaatcggatgcaccgctgtcgagcgcttccctgatcattgactcctgcccgattgccgaacacataataacaaatgccatcggatctctctttttcaattccttcaacacctctatcccattcatgccgggcatggaaatatcaagcagcaccagacccgggcggtattcctgataaagcttaagggcctgcgctccgtccggcgcctccaatacccgaaagccgttctctcccgctatcacctttttcagcatggagcgcataaaagccgcatcatccacgattaatacccatttttctccactcatgataattcaaattcctccaccagttttttcagaatctgagcctgcgccgacagctcctcgctggccgcggcgctctcctcagcggttgcggagtttccctgcacaattgcaatgacctgctctatgccctccctgatttgaagcaccgaatccgcctgatgcacggaggattcggaaatccggccaatcattgccatgatttcaccggtaccctccacaatcttttccagggtgtccgctgcattctttgctgcgcctgttcccctgtccaccttctctcctgtctgctgcgcaagctccgccatcataccggaagcttccgcggtctttgccgcaagactgcgaatctctgaagccacaactgaaaagccgcggcccgcttcgccagccctggcggcctccaccgaggcattcaatgaaagcagattggtctgaaaagcaatatcctcaatctcttccacaattcttccgatattttttgaattttcccggatatctgcaatggcccgcatcatattatccatctgccgatccccgcaggccactatagcgttgacttcctcaaccttcccactggctctcacggaatcgtccgcattatttttgaccttgtcggagatttcattgatgcttgcggccagctcctgcattacggctgcctgctccacagagccctgggacagcatctgagcgcctccgctcacctgttcggaaccgtcggccacctgctccgccgtgttggaaatctgcagtatggctctgttaagcaggcccgtaatcttatccatagcctgcccgattgccataaagtctcccctgtagtcaatctttgaatggtaggtaagccggccgtttcctatggcgtataaaccgctttccatctcagaaacataggtcttgaagcagtcaagggtatccctgacgctgccggccaaagccccgatttcattctccgaacggtacgagatctctgcttccagattgcctttcgccatctcttcagccgccgcctgcagttctctgagaggcaccgtaattccgcgtgtgatttttatccacaggaatatggtgataaagagaacaacggcggcgagggcaattacagacgcatacatccgtctttttaccatatagccgttgttaagataactctcggcgcgctccagcgatttatcggcaattttctgaagagtctctctctcaacctttgtattcggttcataccagctgttatatagttccagggcctcctcataccggcttaattcacacagctcgattgccgtattcctggccggctcgacctttgccatctgctccttcagactgttaagcaattcgtcgctttccagatttttttctagaaatgcaaaaccctcaacaagagtgttttccatctcccttgcctcggcaattttttctaccttttccctgtccgtaacgccggtggcaacatccagtatacatctaccgattccctgaacggatgccttcatatccagagccgtataagagactgcaaatgccttctgataaaatacatcaagtgtattcgatgtcttagctatccccagcagtgaggccgtaaccgtaatgatatacagaaaaatgatagctccgtaggaaatcagcaatttccttccgattttcaaatccttaaacttctttcccatgtctccccttctgcctgagctatatcaagtactttgcatgatttaccgtttcaatctcaagcttaccgtcatctgtataaaaatatatgcttcttccgtaattttctcctgtgtcctctgaaatcacggggatgttcaattcctggagcttctgcctggcacagtcaacattttcccggccaatctcccgatatttctcacgggccgcaaagctgaatattctggctcctccggcaagctttgcccggagatcgtaagcatcggcgccctttgccatcattgcatcatataaagccacaatagaagtatccacgtaccggagctcctgcccggccgcttctttctccggcacccggggcagaagcgtatgcaccatgcctcctatatgccggttcacatcatacatgcagaccgccaggctggaacccagagcaagggatgccagcacggtattctcctctgatacagccagctgaaccggtctgattaatatctgtttcaaagctccacctccaatgcctccagcagcttccctgcggattccttatcaagcataacgagaatgtggctgtcgtccgccccgttaacgctgaaccggttccctatgcacagcacaccgccataattcccggccgtgccaatcaattctgttataatagctccaaccatatccatcgaaactgccgcttccgaaatgtcaatccggcagcccgagcaggccgacagcgccgtaaggtaagatgaggccgttatattggccacttctttcaatatatcgagatgacggccgtccagttcacagctccccggctcccgctccaggactcctcccagaattgtgcttaccatttcatttttatagacctgaagaatcattcccccgatacttccgcaaaacggtatcagtacggcagccacattttcaccggcgtagccgaaccaggaggaaaggccgtcgtatccgcctgcgtttacgacggacggcgaatagttcacctctgcacctataatatgggacagcgaggccatgctggcccctgttccgatatttcccatttcacagaagatatcatttacttgtgcctgctgcacattttttttattccggtacattttataaactcgcttccactaattttaagagcgcctcttctttgaatggtttcactatgaaatccctggccccccgctggatcgcccgggcaataacggactcctggcctatcgcagagcacatcagcaccctggcttccggatcatccgtcagaatgtcgtccagcacctcaagtcctgagcgttccggcattgtaatgtccagaaaaaccagctccggtctttccgatttataaagctccagcgccgcttttccattttccgcctctataatcttgtcatagcccccattgataagcgccttcttaatcagccttctcataaatgccgcatcatccactatcattattgcaggtttcatctaattctacctcctgattttatttctcatccgtatacaaaacccgtttatctcatctgccatggccccaatcggaagctgtttgtccgcgccgcccagaagcagggctgcggacggcatattatatatctcactggtctctctgttctgcaccacagtgaaggcgcccgcttttttcatatcggacaggcctcttgcgccgtctgaccccatcccggtgagaataatccccatcgcattttctgccgccgcccgggcaatagaggagaaaaggtaatcaacagaaggcgcaaatccattcactttttcccccggcgcatttttcagaatatacccggctccgcttttggaaacgctcatctggcagccgtcagaagccagataaaccgtcccgtcccgcaccgcttctccggttctggcttcttttacgtccagccccgtatgaagggccagatattgggcaaacggacctgaaaagcctctgctcagatgctgtacaagcaatatcccgcaggtatccgccggaagagccttcaatatctgcaaaacagccttcgggccgccggccgaacagccgatccccactaaaaagcggctgttacaggacggctccggctctgcagtatatattctttttccggttctgccgacctttattcttataatcagttctctggaaaataattttcttccgctgtccgtatccatggacatcatccggacaaactcgcagccgctgtttaccgcagcgcttcccagcgttttttctccccagacgccgattatctgcaccgactgttttgcagaagcaggcacagaggaatattcgcgcacaaaaaacagttccgtctcacaggccaatattagcgcatcatattctcttaaatgttgttttccgctgtttaaagtccccgggccgaccgtcttagccgttatgccgtcccatttcagcgcttccaggacagcctccttaaggcggagattctccgcgtcaaccgcgactcttatttttttcataatcgctatcctttattttctgtaaacagccgggcacacatattcaaacagctcatggtttcgcggaagcagctccgtatgccctacaaatagatacccctccggcttcagtgcccggtataaattttcaaccagctttttacgggattcctcatcaaaataaatcataacattgcggcacagaatcaaatcgtatctgccaatccccgcattgggcttcatcaggttcatcgtctggaacctgactttctcccggagtgcggcatgaatggcaaagttttccccattaccgtcttttttacagtattttttctgccagcgggccgggatattttccagttctttgaccggatagctgccttccctcgcttttcttaccgccttctccgagagatcggttcccaggatttcaaaatccgggagccagccgccccggtcggtataatcctgtaaaagcattgccagcgtatagcactcctccccgctggaacagcctgccgaccagattctgtatacaaagcggcccggttccggctttacttcgggaagaattttcttctccagaaattcaaaatgctttggctccctaaaaaagtaggtgtaattcgtcgtaagccggtttagcagaatcgttctcagcctgccgctcctgtccgcctccatcagttccatatactgtttcagagaggatatcccatgtttctccagttccggactcatccggcactcggctatcgtccgtttcttagaaagatcaatcccatactgctttcccatatactgtttcagaagctcaaactccctattcgtaaaccgtatcaagccgatcacctccggacagactgtctgccagcagcccgtaaaggcctccgtcttccctgcaaatcaacaccgcacacccgtaggaagatttccgctgtgccccctgcggataccggacggcgatcagtctgttatggaaataaaccataccggctacatcctccggcgctcccggcacggcaataatctccggcctcgacagaatcattccaacctgctccatcggcacccgtgcatatccgtctccgcaatataattccaaatatccgtttttcgtttcctctgccattttccctaacatccctcataatttccatacatctgcggtaaatagtcttcgatgggagccggccggccgtaccggtatccctgcgccaaatcgcagccgatttcttttaagaacaattcgtgttccattgtctcaatgccttccgatattacctggatatcaagctgcttcgccatatggattacattggaaataataactttctcccgtctgctcagatcttttctgaaaaactccatatccaattttataatatcaaccggaagatcctttaacaggctgagagaagaataaccggtgccaaagtcatccattgtcaatataaagccctgctccttaattttcctggccatccccagaatgcgcttcggctcatgcagaaatgcactttcggtaatttcaagctcaagatacttttcgggaatgccgtgtttttcagtaagcgttgtaagcccatccatgaaattatccttgttgatgtggagcctggatatgttgaccgctattggaaatggttccttcccctcatctatccagcttcttatctgctcacagacacgttccaggacatagaggtccagctccgtaataaatccgtttttttcaaaaagaggaataaaatcgttgggaggtataatttcaccttcctccgtcttccatcggaccagagcctccagaccgataattttatgctgagagagactgattttaggctggtaataaacaagaaattctttacgttccagcgcccccttcatcctcaggctcattttgcgctccttggcatattccagttccgcctctttgttataaaagttataggcgcttttatgataatctttctgtgccttccttgccatgttggcgtgatccgcgagaacagacatatccttgtctcccggttccaccaggcagattcccatgacacagcttaaattaaagtccagtttttcatctgccgttatctgctcgacacgccgtatcaactgctccagcctgtgcagcagaccgttcattgtctgatattccagaagcagaatgaatttgtcggcttcaatcctcgcaaagcactcatttcctccggtaaagctgttcagcaaaagactgatatgaatcaaaatcgtattgcctgtctcgaaaccgtaaccggcattaatcactctgaaatttttaatatccattgtcaccacagcctgcagcagtgagctgctttgcagccttctgctcccctcgtccagaaaacggctgtatttccatgcctcggtcaaacggtcataatccatcatgatttttgtaaagcgctggaaacgcagctgcataatctgcgacgctatgactctcccggccagataaaacgtcattatctcacgctgcgaccagattctctcctttatgctgtcgtttatgctgatatagccaaccacaacgcctgactccataatcggacactgaagcagagccttgctgtttctcagcttctggcgctcggcgctgataggattcagccgttccagctcctgtattctgttgcatacaaggactttctgatgtccgaacagctccagataccgctctcccaccagactcggaattactctgaggttgttattatttacgcagggtgtaaaggaacgccagtcaaacgtgacttcaaatcccttccctcccgattttcgttctacaatatagctctctccggccccaaaataacggcatattttttcaagtccgcggttcaccgacgcttcacaatccataccgcaatcagacaaatccatcatttcacggacaaattccatgtccgccattctgctgtccggctcgtattcccttatcggcccaaaggcccagccgctctcttcttcactccccccgtctcccggcttcatcagataaaagcagcttttttcttttttcgcacgaaacagacctgctttggcctcattcaacaggctttcataggtctgtccctcaccattggacactgccccgccggcagcaaatgaaaacccgccgtcacggagtgcttcttttttaacagtgtcaattaaattatataacacgtctttacttcggcatcccagcaaaaacacaagaaaacaggcgtcgccaatccttgccaccgtatccgtcctcttcagcgtgtcctgtaaaaagaaggacattcttttcagtacgccatcctctgccctctgttctccatctgcaattccgctctcatttaccccggtaaattcgatcaaaagaagagcatcgcctccccaccgggtccttccgagcagataacggccgattatatcctccgccgcttgtgcggaccatgctctggtcaatgcatccagactgtcttttctctccactgccattattcaatacctctctgccgtaaaaatatgtctggttttacgataaacgcccaggaagccagttcctccacataggcggcttttaacagacaggaattatccgtacctatggcttctccggggatgtccttctgccggccctgagaaaccgtataaatccccctgacctcatcggccgaaaagccctggtcttcctccgttccgttcagcaggacaatatacctgccgcaagcggcccgttccctgtcagagaagcggcagaagccggtgagtctgacctcactcccattgtaataaacaggcccttctccgttattgcccggaatgatatgcttcaccagctccaggggaatcaaaaaaagagcggcttcgatttcaaaacacaaaaatgtttctcccataaagcccctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgctgtctatgctatggacttcgaggaaaacaaatacatctcatcatcgtttggcaataaccagccgggtgccgataagcttgttaatatgattgctgagtgtatgcacaagcataaaaacctgaatacgattcttatcgtgctggaatccacttctgtatacagcgtccatatttcaaacttcctatcgaccagcgaggttctcatgccctacaagccttacgtcttctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggatctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgcttttccttgtttcttaattattttaatcggaatgcactgatcaggttcttaagcgtctccgcttgcccggacagttcctcactggcggcagcgctttcctccgctgtggcggaattattctgtactacgcctgcaatctggctgatattttgtgtgagctgctctaccgactcggactgttccgacgatgctgcagatatattctccactgccgctacaatttcttttacaccgatcaccacattctgcagggagtccgccgtctcattcgctatcataagcccgttctcaactgcactcagagattcgctgatcagagccgacgtgctcctggtggcttctttactcttcgcggaaagctgctgtacttcgtccgcaatcacggcaaagccttttccgctgactcccgcccgggctgcctccaccttggcattcagcgcaagaatattagtctggaaggcaatctcttctattgtatcgataatcttctttatctgttccgaactgctgctgatatcgtccatggcggaaagcatctttttcattctttcattgctctcctccatctcatggcccaccacacctgcttttttatttgcattagaggcatcataggcattgctgcctattttttccgcaagccggctgattgtatcagcaagtgtctccaccgtcaacgcctgctctgatgaacctgccgccagctcctgcgctccgtaagagacctgctccgaacctcctgctacctgatccgccgaactgttgatctgctttatcgtatcacttaaatctgttgtcatctgccggattgaatccagcagcggccggaactctcctacgtattcgctctcattgcgggtgtctatggcaaaattgctttccgatatctgcttcaaaagatacgtcaaatcattaattacgaaggtgatacgtgcaatcgtaatccgcatactgtcggcaaggcctcccagctcatcgccggagttatatgtaattgacacgtcatgcatctttcctgacgccagccattcggccgcctgctccagctcggatatgggacgggtgatgcttcttgtgatatacagggcaaaaccgacgctgatgccgatgctcagcaccgtcagcaccgccagcgagacaatcgaatttgtcctggcctggcgcaccgcattaatcagttcaatccccttattgtttgaggaggtgattattaaatttatattctttcttatattggtattgaccggacggatgtaagcttccatatagtccagagcttcctggtcctgattctttgaggccagctccagcacatgttggttcatggggaacacctccgaaaaaagggtatccagctcctccacaatctgctgatcgcccagaaaatgttcagaaataaccggaagctccgcctggatattcactttcgattcatccgccgctaaaacggagtccccgataatctggctgtcctcatttgcaatggcccgcagcatcgatttctggagtgattcgaaattaacgctgacggaattaacagagccccttacattaaacggcccgtcataaaagctctccactctttccccaacttctattaagttcctgatgtttacaatagagcccaaaatcagcagaaacataatagtaatataggaaatagccagtttttttcccaccttataatttttcataatctcgatattccttccggatttgtcaatttcttcctccctctatcttacaataaataacaatatccagcaagctgaatctcccttttccataattattccaatatattccagatgtcggaatcattcctgtcctgataattttccggcgtccgtatattttttcttgttcgggagaatactaagcaaaacggaaaaatccgtatacaggaaaggatggtagaatatgcagaaaactataaatgtaatcgctctcaccatagctattatcggtgcgatcaactgggggcttatcgggttctttaactttaacctcgtttcctatctctttggttccgcttccatgctgtccaaagttatctatgctctggtaggaatctgcggtttatatcttatcggcttctacggccctgtgacacaggagaaataacgataatctgcacgctccgcgcacaggtcaccgcctttaatgaaaaaccacccggcaaaacctgcgccgtgcagggctgccgtgaaacagacagcttcaaaaacaggggaggctgtgaccggtaccggtcacagcctcccctgagctctgtccttctgtaatgaactctgtccttcacaaaacgcgctttttattactttactccgaaatgctcaaacagtaccttctcagcctctgcacaccagagtcctttatgcgctttacagcactcatccagcttcttaaacagcggatccctctctcccagcttcgcaaaatcatcgatagcggtcaaaggcatatcgaactgggtataagtcagttttttgcctcccggaatagacggcagattcttcgttgcctctgcaatgctgtcgattccgcccacatgagttaccataacagccggttcgattgctcccctggccgaaagctcattggcctcgatcaggtcatccgtatttccccctgttgttcccatgatatgcgtgcttgtgtagtgacagttatagaggttgatttccgccttaaactggctgtcggtcggccctgcaaagaaattcatgcagccgtcaaatgccagtagcttatctcccatctccgcaacctgcctgattggggcatagacaaatacgtcgtcgtatccgtgatcctgtgtaatggccatcagctccgcaatcggatccgccatcccggcagtatttacatagtgcagctccacgcccatttctttggcatgctcctcggaaatcacttcccttgcacggttaattctgtcttcatttacatcggtcactacaattcgcttcggtttattttcaaactggatgccatagcttaccgctccgagtcccatcggtccgcagcctcccataatcaggatattgccgtccgttttggttcccatggcatgctcgtaatttttcttgttcgtatggtaattggcatggtacccgccgataatacagctcatcggttcgccgagagatgcctggaaatagctttcgccgtcatagcttaaaagacagcccatctccattacctcatgaggaatgatgcagtatgtggcggctccgccgcagaactcataagaatatcccggcgagtccagcttgccctggtaattgatagccggctggatcgaaaatttctgtcccggtttaaactgatcctgccacttttttcccacctgcacgatgtcaccggcaaattcgtgtccgacgataatcgggttggtatcgatgttctggggcgcgcgcttatgctttttcccctgcttaaccagtttgtaggtcgacatacagatgctgtcgctcattacctttacaagaatctcatcatcctttatctccggtaattcaaattcttctaatcttaagtcatcaagtccatacattcttaccgctcttgttttcattatttccaacctccgttttcattagctaaaatatgctgcttaacccgcctgcgctctttctcaggctttcgttgtaaatgctgcgtaaatatcatcggcgctgcccttaatcagttcttccactgcttcaggcgttgccatcttttccgctattgttgctaaaatctcaagatggtcttctcccacccctgcgataccgatgaccaggttaaccttctcggttccccagtcggttccctccgggaataccatcaccgcaatgccggagtgcttaatctctttcttggcctcttccactccatgggggagagcaattccgtttcctatattggtagggaacgacaattcccttttaatcatcgcttctatataaccttcatccacatatccgctgtcgcagagaagctgtccgactgcgcggattacatcatctctcgccatcgggctgcagtccagcctgatgttcttcttttctaaaagctccggtttctgaattttttcggtctgttcttttttctttccaaaaccaaacattctctttcctcctcgatatcacacagtgctttatctgatggcccgcgccggccattccggccgaaccgctccaggctctctgaattcattatatcctgactgccggatacaattcaacagaaacaaaattgcatttggcatcattggatggtgacaaaagctgaagtttgcacgaaaatcccgagttgaacggcgcgacgcgatgaaaagtgaacttttcaccacaatcaacggcgttttttgccgtttctgtgcatcgcgaaacgtgttattattcacagcacgccgctttttggcggagtgtgaacaataacgttatattttatccagataccggttaaaatattttttcagatagcgcgacagcagccccctgatatcctcttcttctcccgtcataatggtgtttaaaaattcatcctcctccaccagcttctgactcagataacctaacatggaggcattttcattcacatgctcttcttccggcatgagcatgataatagcagccctgatccctttcatatcaggagaaaggaactgttttcctgtctccggtttaaaaacagtaaagacgggccgcgctacgccggctgtccttgcatggagaagagcgaaggaaaagtccggaaagaactgggagcccatggtttctcttctttttaaggcatctattatcattttctgccggtcggcgtagggtgtctgtccctctcccacccgtaccagcaattcctcaaatgtgactgtctcatccgtcctgacaagctgaaagcgttgaatcagcgacttgatctgagccgccatgtaattgacttcctcaagctgccttgtgaacgtttcgtcttcctgcctgactgcaggcatatgttcatattcccgcaccttggctgctatctgctccatctcccgggcagtcagcagaggactcacatagagtatgtcagccgcctccttaagctgcagcgtggaaacgaagaaatcggtccgctccagcacatagggcgataaatcattcaatccatacgccgtcaggttgatccggtcattgaaaaaacggttgattctggagcacatcaggcgggaaataccgattccgctcgcacagaccacccccatgttgacttttcttttgacttccctgctgctctcaagacgcaccatggccgctccgaaatggatcgccagatatcctatctccggctccggcaccggataaccgtaatgttcttcaatcacctctgcaacgctgcggcaccgttcaaatattgccgcataatcacgttttatctgatccagcagcggattttctatcttcatattgttggccaggcgtaccagtgtaggctgcagatgggccgccaggccgtgtaccacaaattcctcatcctgctttaactgccatgcaacaaccggatcaaagcggtcgatcatctggtttaccacctcaagcagttccctctggctgctgactcttgccctggaatcctcatccagctcaatctgctgcacctttgcccccttaatatgaagacagatataggccgtctctatctccggaatctctatctcaaactctttgcacagctcttccacaatcctgcccgcgaggcaaaaatcatcattccccctgagcgattccaccatggcctggttctcttccagtatttccttctttaaaatcctgttgacggcaatcgtcacatggagtaccagtccgacatacgaattttccgtcaggtttaatagtctccggtccttgatcctctgtatacaggcaatcaccctaagcagaagatcgttatttaaaatcttatagatatttttgtcatttttactgcccaccagttcaaacagagcctgagccttttcttcatagatatccctgataaaatgcgtatctatattctcatcgataaaagccctgagggcaagacggaaatctttttccctgccctctatggaaattccgtagcccggtttcctgatgattttcaggttaaaaggctcgaaccattcctctgccgcctccagatccgcgctgattgtagcctcgcttacgccaaaaagctcgctgtaataatacagctttttcaatgttttgtccttcaatatctccagtatcagcctcttacgccgttccggacggtcggaagcatccagggtatctttttcactgagatggcgcaaaagcctgtcccggtcctcccgggccccttccagccatacgcctgtcccggttttggaacagaactccacatgatattccttcagggccctgcccagatattccagttccctctgaaccgtgcgtttgctcagattcatccgttccgccaggtttttgacagatatgaccttgtcctcattcagcataattaaaagtatctgctgcattctcggtgtaaaatccatatcaataccgttccctctcccacgctctctgcctcatcttgtccggcggccccacaccgtgaggatttatgccgccaatcgatagaaagacagaaccggggcatggatggcatgccctgtttctgtcttaactatattctatccgtatccggattacaagaatctttatgccccgccggccttatctgcctgataattctttaatcagttcatcatattccggcgctgccaggaaattggtaatcagaaccagccgcgcattcgggttgctgtggcctgccctctctcccagctcctgatgcgtcaccacaatctgcgcgtcggatgggatggatgatacgggggaatgcataacctcaataccgccaagtcccgcagccgtcagttttttcttaaggacagtggctcccattgcactggagcccattccggcgtcgcatgcaaatacgattttcctgatgtccttcgtatcaactgccactgctttcttctcatcagcgatgccctttgccgcattcttcatctctttcattctgttctttgagctttcgagatcttcatcctttgcggcgaatttgagaatcggcatggaaatgaagaaggataccgccgtggctaccagaaccccgagtataaccggaagataacctcctctcggcgtcatgcccaggattgcaataatacttcccggtgaagccggcgccgaaaggcctgcgccaaacatctgctctacgaagataccgctggctccgcctgcaatgactgagagaagcaggagcgggttcatcaggatatatggaaaataaatttcatggataccgccgaggaaatggataatgacagcgcccggcgctgagcttttagccgatccttttcccgcaaggcagtatgccagcagtacgccgagtcccggtccgggattggcttcaagcaggaagaaaattgattttccggtctcttccacctgctggattcccatcggtgagaaaattccatggttaatcgcattgtttaaaaacagaacctttgccggttcaataaaaatacttgccatcggaagcagtttattgtccacgaagaaaccaacgcctgccctcatcgcctcgtttaatgactcaacaagtggtgtgactcccttcagtgtgagcagtgtcagaacagcgccgagaatgccgagtgaaaaattattgacaagcatctcaaagcctgcaggaatcttcccttccaacagccggtcgaatttcttcataacccaggccgccagcggacctacgatcatcgcgccgataaacatcgggatatcggaacctacgattacgcccattgttgcaatagcgccgattacaccgcctctctggccgtgaatggcagcgccgcccgtataggcaatcagcagcggcagaagcacggttgacatcggcgatacgagtgccgcaagactttcattgggccaccagcccgtcgggatgaataacgcggtaatcagcccccatgcaataaatgcaccgatattcggcataaccattccgcttaaaaaccgtccgaataattgaactttttctttcatacatttaccctctttccacttttactctattttccgttcttattacgtttccagttttataaaagtgaccggccggtcatttcttttgatagttttattatacccggcctgagggaaatatttcaacattaagaaataaggatttgtcactatgtaatagtgccaaaactccgtctgacagtgaccatttatatcagttcagacaacatcagccgttactgctgatttcagtactgcatctcacacacagaagctggatgcggcccgtttcagataatccaggaaattcgcttttctgatgctctcggcggctacgatttccaccctgccaatctcctgcccgttcaaacggtatacgagatagccgaggatatccccttcatttacgggcgctttaatttcatcttcaaatacccactccttctcgattcctccgaagtcttcccctttcatcgtcagataggaaaaaattccgttgagctttgccggtaccgtatcctgaattccgtttataatcacggccggaggcacggaccccgggtcttcgtcacggtacatcctgcaattggcatatccatagttaagcagggtcagggcatccccaaacctggctttgaaatccggggcagctaaaataacggcaatcagctccactccgtcttttctggccgttgcggacagacagtattttgccagggacgtggaacctgtcttaagtcccgtcacttcaaaattagtcgccatcttcagcagcttattcgtattggagagtccgaattcttttgtcccctgcttcgtcacgtgggtgatgttttccatccagatggtcgaataattgaatatctcgggatattttgtgataagctcctttgtcataagggcgatatcccgggccgacatggcatgggtcgtggaatccgtcagtccgcagcagtcttcaaaattggcgttctccattcccaggcctttggccctctcgttcatcatcttaacgaatgtggcctcgtctccccctatgtattcagccatcgctacgcttgcatcatttcccgacgcgatgacaatacatttaatgagcgtctccactgtctgaatctcgccctcctccagaaaaacctgggaaccgcccatggattttgcatgggcgctggttacgacttcgtcatccaggtgtatcttccctgatttcagggcatcaaaaatcaggagcagcgtcatgattttcgtaacgctggccgggttcctggcctcatccgcatttttttcataaattaccgttcctgtggaagcttctatcaggatcgcgtcgggcgcctggatttccggcccgtccgccgcctgtaccatcgctgaagctgcctcggccggaatctccgggacagaagcatacacactgtaaagccctgtctgcaggaccatcataatcgtcaaaataaccgccgttaatcgtttcataccttttctccgcatctatttccttctttaatcaggatatggacagaatgcatgtacttatgactccgcgttccatgaaacgttcttttctttccgacaaaattttatagctgcgggggatgtgaaccatatcaatccggcatttaccagtaaaatttaagtaaactgtaatagtcatcggtttgattctatgttataataatatgccgggctttttacggcctacttttttgtccaattatcttacagatagtttcattaacatattaattcataattttagataaaggtgatgcaatactatgggaaaagatcaattttcattgaaaaacagcgggtactccagctattccagacgacgtaaaaggaagtttctcaggatactgccctacattatactcggatcgattctggccattctcttatgcatagcaggatacctctatatgaggaataaaagtctggaggccaggggcgcttctatcgctgaggttttgaccggcgccaatccttccggaccggcggactctgataatccggggattgccggggaatcatcctctgaggagtcttcttctgcagacgcggacagcgaaagcctggaaagttacctgtcacgggcaggtcttctggccgcaggatacgactatgacggcgctatcaccatgttgagcgaaagtccctatgcttcggacgaacaggtcaaagcggctattgccggatatgaagagaataaaaccgctctcgtgcgggccgacccgaagaaggtgactcatgtcttcttccactccctgattatagacacctccaaggcgtttgacggagactccagggagaagggctataaccaggtgatgactaccaaggatgaatttatgaaaattcttcagtccatgtacgacagagggtttgtacttgtccggcttcacgacgtagcttacgagacaacaggggaggacggcaatccgcactttgtggaaggcaacattatgctgcctccgggcaaacagccctttgtcatgtcgcaggacgatgtctgttattatgaatatatggaaaaagacggttttgccaccaagatgattatcggggaggacggaaggccgacaaatgagatgaagctggatgacggctccgtactggtcggttcctatgacctggtccccctgcttcaggatttcatcgacgaacaccctgatttctcttataaaggcgccaaagccgtgattgcctttaccggatataacggcatcctcggctatcgtaccgcagcttcctataatacggacgagtacaaagcaaagcatcccggttttgattatgagaaagagcgggaggaagccgccaaggtggcggaatgcctgaaggaaaacggctttgaactggcttcacacagctggggccaccgcaatatgggaaccatatccatggaacatttccgggccgacacagacaagtgggaggccgaagtagagacgctgaccgggccgtgcgatattattttattccccttcggcagcgatatcggcggctggaagccctatgataccagcagtgaacgctaccagtacctgcactcgaaaggtttccgctatttctgcaatgtggattccagccagtactgggtacagatcggcgacgattatatgagacagggacggcggaatctggacggtttccgtatgtattacgacttgccggaaaccaatcccaccaaagaccatttaagcgatttattcgacgtgtctgaggtctttgacaggagacggccgacaccggtccccaagatgtcggaatagttcattgggtatgaacaggaaccattcggagttgtgaattttgacagccgcgaaatcccattgacagggagcggcggttcctatataataaaatcataaaagagcttttgcggattatatattattttccgtaacggctcttttttgtgcgtttaaaagtagtttaaaagaaagagaggctggaacgatgaaaacaaaacttataagcagtttgaaaataatcggagtggaacttttaggcagtattttgattgcggtaggtatttacaactttgcagcggcttccgcatttccgatgaccggtttttcaggaatagccctgattttcaaccggctgtttgcactgcccgtcggcctcacaatcattgtcctgaatgttccggtagcggcgctgtgctacaaactcctgggcaaacagttctttctgcgttccgtgcgctgtatggtcatctcatcaattatgatcgactatcttgcccccctgttcccggtatacaccggaagcaggatgctggcggcaatctgcacaggcgtgctggccgggctgggctatgccattatctatatgcagaattcctctaccggaggcaccgactttatcataatggcagtaaaagccttaaagccttacttatccctcggtaaaatcgcttttttgtcggacgtgggaattatcctgatcggaggcatcctgttccgtgatatggacggaatcgtatacggcatgattatcaatttcctgtttgccgtcgttgttgacaaagcggtatatggcattaatgccggaaagatggccatgattgtgacggacaaaggcgagcaggtgacgaaagcaattgacgcctgctgcaacaggggcagcacaattttaaagggaatgggaggatataaaatggataaaaaagaagttgtgatctgcgcctgcaataataaagaaatgttttttgtccagcaggttgtaaaagaggtggatccggccgcattcactgtcgttcttgaatcaaacgaagtccatggtgagggatttaaaatgttccagataggcgaggggaacgtaacagttcagacaggactgcgcacttgctgcgcggaccgtgcgaaaatgcagcggcagtaagcatccggctgataaaccggcttctcatggcaccagactttacggtgacagaaaaaagagcaggaagattgcctgctcttttcaatcttaattattgtttgtcttgctcaaaatagtgcctgtgcagtgcagcctaaaactgaactatctctttaatcggttccgccttctccacatattctgcatagagcatcggtccctcgccttcatattccggactgtattcatactcaacgcgcgctctcaccttgacccactcttttgtctctaagagccttgcatttctggctttgcacatgaaacccaagaatgtcatatcggcttcacaacatgtcattgccattctgcccggtacgaaatagtttttcgggaaatccggtgtctttaataccattgccgtaaattcaaccgtctttccacggtaccgctccggtttatcaagcatgtctatataccagatgccgtatgcctccggagacacctcaattatatcggcatttacatcgtatggaagatccgcctcggagatttcactgatctcgccttccgaatcttcgaatactatctgtacctgaggattcatccccttcagtgttctgcggtaggaatccagatcttcgattccgtcgcagcggttcatgatcagcatctccgtattacgtaccatgctgcccaccagcggtttcatgttgttgagatacaaatcaaagctggaaccgtccacaatggtaatctgctggtaaagatcccagtcggccgggagcttcagcccctccgggttccacatgccgttccactccatcagcacacgctccggattataaagaagctccagctcctccaggtattccggcgtgagctttgaaatctcatcaatatacacggcggctgttttcgtctccctgaggaactcctcttcgtactcttcttcgccctcttcacaaacgatcagtaaagtctttccttccgactgaaagtaatcctgctgaagcgtgaatttgataaaagcagttttgcctgcctccaaaaaaccgtttatcagaaataacggcattctatcgtcttccattacttatttctccttttatgcacagtctgcccgcttccggctgtgccttaactctgtcaatcaggcgttaaatgcctccgccagtccttcttcatccaggttagccccaatgacacagagcttgcccgtatagtcaggggaaccttcacggatttcaatctgctccggaaccaaatcaaaatgaatccatacgccctctttttcacccgggatcatacctttggcacggagaacttgaccgtatttctgtccatatgccagctccttcagcaccgcctccagtttatcgcggctgatggcggatacgttctctctgccccagcttgtaaatacttcatcggcatgatgatggccgtgatcatgagcgtgatgatggtcatgatcgtgacagccgcaggtacagctttcatcatggtcgtgatgatgatggccgtggtcatgcgcgtgatcgtggtcatgcgcgtggcagccgcattcctcgccgtggtcatggccgtggtgatgatcatgctcatgttcatggcagccgcagttacactcaccgtcatgtccgccttcatgatgatgctcatggtgatgcccgtgatcatggcagccgcattcttctccatgctcctgatcgtggtgatgggaatgggcgtgtttatgctctctggcctcacgcatcaattcctccgccatatcgtccttcttttcaatgatctcaagaagctgtgcgcctgtaagctggccgcacggagtcgtcacaatattggcgtccgcgttatgctcccggagcatcgcaaccgccgccttcaccttgtcggcgccggcaatatcggtccggctcaggatgatggtgccggcattctcaatctgattattgaaaaactcgccgaaattcttcatatacatacggcatttgttcacatccacaacagtaaccgcactgttcagcatgacttcgatctcggaagccacatctctcaccgctttcatgacatctgaaagcttgccgacgccggacggttcaataattacacgatccggatgatacttcgtcaggacttcctccagggattttccgaaatccccgactagggagcagcagatacagccagaattcatctcacggatctcgatccccgcatcccttaaaaagcctccgtcaattccaatctctccaaattcattttcaatcagcactactttttcgcctgagatggcttccttcaggagctgtttaataaatgtcgtctttcccgctccaaggaaaccggaaataatatcaatctttgtcattattatcaaccttcttttctgtttaacagtagttttaacctaatttattatttttacacaaatatggaataaagtcaagcaggtgagaattacggtcaataaaacggccggtatgaaagtatctcataccggccgccctgcggcttttatctctaccagctgaacccctgacgcaccgcctgaaccagactgaatatcaggaacgccgccagatttacgactaccacactggctcccgccggagtggaatagatataggatatcaccattccgatactgaaacagatgatagaaagcaccccggatacaattacgactcccctgaaacttttaaagatccgcatggccgtcagggacggaaagataatgagactggaaatcagcatggctcccatcatcctcattccgatcacgatcgtcactgcagttaaaacggcaatcagaacattataaatcgaaacattgacaccggtggcccttgcaaaattctcatcgaaggtcacggcaaaaatcttattgtagcagaataaaaacaggccgaggacaatgacggaaagaatggcggcaaaccgcacatcctctttgctcatggccagaatgcttccaaacatatagctgctcacatccgtggtcatccctgtagtcatggaggtcacaataataccgattgccagtgcgctggctgatatcatcgcaatggcggcatcactttttatctttcctctctccgtgattctgagaaggaaaaaggccgccagcaccacaaccgggattgaaattttaagaggcgaccagcccgctgccagagccaccgacagggcgccgaaggatacatgggacagcccgtcccctatcatggaataacgtttcagcacaaggctgactcccagcagggaagcacagagagagacgagtacaccgcctatcagcgccctcacaataaatgggtaggacatcatttcactgattatgctcattcctcctcacctcccagaaactggtttcctatgccgctttttaaataatcctgaaccgttccccaaaaaagcgccttctgctgaagatggagaatctttcccgcctgtctgacgatattcgccatgtcgtgggataccatcaggatcgccacctgctcttcccggttcagctttcttataatattataaaagtcctgtatcgccgaaggatccagccctgtaatcggttcgtccagaatcagaagcttatcggtggcgcagagggctctggcaatcaacgctctctgcttctgccctcccgacagatcccggaagcagcttttcttaaggtccgcgatccccagcctctccagattggaaagagctgtctgcttctcttttggggagtagaacggacggtttcctctttttccaaggcagccggaaataaccacctcaaatacggtggcaggaaaatccttctgcgccgccgtctgctgcggcagataaccaataccggctttcttaagctcttccgatatttcaatctttccctccgtaggttttaacagccccagaatccccttcatcagggtgcttttaccggaaccattttcgcccacgatacagatataatcgcctgtgctgacctccaggctcacatcaatgaccgcatcctgattctcatatccaaaatcaacatgctcacattttaacaataatcccatctattcaagtccttttctcaggttcaccacattctgctccatcagttccaggtacgttatgcccgaatcaaattgtcttctggtcacgttgtggcaggagtggaacagcaaaggctcagctcctgtctcctccccgattatctcagccacgcggtggctggaaagctccagataataaactgccgggatcgaatcctccctgaccttgtcaatcagatatgctatcgtctttgcgctgggttccgtatccgtgctgcatccggtaaatgccgccctgtattccagcccatattcatcgaagaaataacgcagcggaaatttgtcgccaaacacaagcagcctcctgtgtccgccggctactacttcccgtatctctctgtcaagagcctccagtttttctacatacgcatcagcccctgcccggtagtccgccgcatgggccgggtcttcctcctgaagcacgccggccagaatctccgtcagcttcatagcgttcacaggggaagtccagatatgctcatcatactctatctcgacttcatgtccgtcatcatgctcatggctgtgacggtctgaggaatggtcatgttcctccgcttccatcccttcgacaatctcttcctccaccgtatccacataatccatcattgtcacgacccgtccgggaccggcgccgtttccaaaagaatccagcactttatcaagccactgttccattgcgccgccgttacataccagaatatcagcattctgtatcgtaatcatatcggccggcgtgggttcgaaggagtggctgtccataccggccggaaccaccatggtcagttctatcctgtctcctgcaatctgacgcagaaaatcgtaatagggaaacagcgttgtcactacgttgagcctgtcttccccgtcagacgctgttaatgcctcttggtcctttcttacgtcactgccgccgggattataccggcggcagcccgccgtctggattacagcggcagataaaataagcaggagcaaaagccgggcaaaaaggcccggtaagcgtgatctggtatttacagtcattgcaaatcctcattccctgtgtcagctttttctataatcaattccacctgggatggataatccactatatattggggtgacagcgccaccagctcttctctgtccctgaagccccaggttacccccaccgtatccatgccggccgcaatccccgtcttcatatccgtgtttgtatctcccagatacaggcagtcaccgggctgcatccccagttcacggcatacgatcagcgccccgtccggagccggcttcttaggcgttcctgcctgctcgcctctgacgcagtcaaaataatcttttccaaatattgtctcaatattctccaccgcctgatgatgcggcttattggagtatactgctatcttcatcccttttttcttcaggtattcaagaagctggggaattccgtcataaggttttacatctttcatacagtatttcgcgaagttctccatatatagcgtcagagcttcttcataatgaaccaaattttcatcgccgcaggccataagggcgcgctccatctgtttcttatagccgtctccgaccatctttttcgtctgctccggcacaatctgccccaggccaagggccgacagcgtaacattagtcgtataagtcagggcattaattgtgttcagcaatgtcccatcgagatcaaaaatacataaacggtacatttttctcttcctttcggtgtaaatttcccccatgtaataatatactaaatgggcgaaagttgcaacggggactttagttaagcaggtggggacgcagcagggacggacggcggacgggcggtggaggtggatcgaggagtctttcgtcccgtgggaaggttgtcgcaagccgggactgcaaagaagatagagtcttcaattaaataattatgatgttgggagcaaaaggtcttttgccccctttgataccggattgctctgcactgcgtggtatcataattattaagattttcaatctctatagatcactcatccccatcatgatacaatgaagtcaaccaaatcaatttcttcaaggaggtaagtatgaacacaccaaaacgaccggcggttaatagaataaacactgtaatcgactgtggtgacgcacagattatggcagaattctacagcaggcttctggggtgggaactgactcttcctgccgcgaacggatgggccgccgtcacatcgccggagggagccgtatttgcatttcaggagatcgaggggtatgaacctccggtatggccctgggagaaaggtaaacaggggcagatgattcatctggatttctgggtggacaatctggaggaaggcgttgagtttgccctggcctgcggggctgttgaatcggctcagcagttttttacgacctcccgcaccttactcgaccctgcgggacatccgttctgtattgatactgatggagaggaaccctgactttaactcttaaaggaggctatctatgaaaaagaatttacaaattatttcatccgcaattgtcatgacgctgtttttcactttccctgcatttgccggtcaatggatacaggatgcaggaagaccggctgtcagtgacggcgtatccaactggcgctggcaggaagacgacggtacgtatgtacaggactgcgatctctggctggacggaaacaaggacgggatttatgaaaactactattttaactccggcggctggatgcttgccgccacacagaatggctatggccaaactattaattccgacggcgctctcctgaataatgacggcagcgttttccggataattgcgccaaaagacagcgcagtcataacgactcccgattatacgctcacactgccggaaaactggaaaaacaatttctgctactccctccgcaacgggaacctctatgtggatttccatcctattaaaccgctcttaatggacggcaaaaacaggggctccgtcacccaggccatgttctggattcttagttttgacagcagggaagagatggagaaaataagaaatcagggtctctacgacagctggcgtcttctgggcagcagcaatggcaagtattatgtctcctgcggccccacggataccgccatcgaattttacactgaggaggacagggccgttatgcagcagatgcagtccgctctttatgaaaatgggcaatcttcgctctggaacaggatggtatttgtatctgccggtaactgatagttttatctaatctgctttttatggagggaggaaaattacatgaaccgacaattgttgaaacttccgctttacaccctggccgccggggttcttacaagacttctcataaaagtgattagctccctggccctgcattccgccggagcgtgggcagtgtatttaggggatgtgatattctacgcccagtgcgtcatttccgcgatgttttttatcatcattggcctgagattacgcaaaatatacacccgcagcgtctgtttccgggccgcttctgtcttagccctctactctctcctatcccttgtactggaacaggcaatgcagtacagcgggcactacggtttgctgaactactatatgtaccttcccatcgagattttcacaccgatcacggccctgctgatgcgattcttctatgaaggagctgtcagcgtggtttatgccgtgccttccctgctggccccttatctttttctgctgttcaccgataaatagagatttaactgaggttgggaggacgcgtccggaacggaccaggtccggtgtggtgagggggatggctgagtcttccgtccccgtgggaggttggtcgtgaagggggaagtaggcggaatcaattgctgcggggaccgtttgcactctttggagtgcgaggcagtgctaagctcgtgagggacctcgccaagcaccggcggactcccatgtcccctccgcaattgattccgcctacttccccggggcagattttcgccggggacggaagactcaggcggaggttttcgcacaccggacatggtccgttccggccgctgatttgcgaggtcctctcgagcttagcagcgcgatgcatttcacagagcgggagtgtgctccgcagactttatcttcgcccgcagccccataccgcgacaatcctccccgggacgaaagactcatatacacatcccaccaccccgtccgccggccgtaccggcggcgtcctcacctgcttaactatcaattaaacattctttttaagagccgcgagaatcacacaccccactgcagatccggccgccacggctgccaggtacccgattggattcccgattgtcggaagaacaaagatacctccgtgcggcgccctgagcgtacagccaaggagcatggacagacctcctgctacggctgagcctgcaatacaggatggaatcacgcgcagcggatcctgggcagcaaacgggatagctccctccgagatgaaggacaaacccataatatagtttacaagacctgactgacgctcttttaccgtgaatttctttttgaaaaatgtggttgccagggcaatggccagcggaggaaccatacctcctgccattactgccgccataacgtcaaagttgccttccgcaagctgcgccgttccgaatacataggccgctttgttgacagggccgcccatatctacggacatcatgccgccgaccaccatgccaagaatcactttgctggttccgcccatgctgttcagcagattggacaggccgtcgttgatggctccgacaaaaggattaataatcgtcgtgattacagctaccagaaaaatgccgagaaccggatataaaagaatcggtttaattccgtccagtgatttcggcagcctgctaaataccttcttcaacaacaggataaggtatccgccgataaatcctgccagcagtgctcccaggaacccggcattcacatcgcctcctgccggattggcaaaagtcattcccatcttagccaccagcccgccgacaaagccgactgccagtcccggacggtctgcaatactcatggcaatgaaacctgacagaacgggaagcatcatgccaaacgcctgctctcccactgtcttcagataggccgccagcggcgtattcttaccaaaattggcgggatccagtgaataatcatcaaacaggaaggccagggctatcaggatgccgccgccgattacaaacggcagcatataggaaacaccattcatcagatgcttataaatgcttcttcccagattttccttgtcggcagattccgtctctccggctccgccgtctgccgcatgatggtaaatgggcgcttctccggcctcaattttcttaatcagttcttccgctttgtgaataccgtcggaaacaggcgctattatgaccggcttaccgttaaaacgggccatttcaacattcttatcggccgctatgatgataccgtccgctgcctcgatttcctcttttgtcagatggttctgtactccgtctgcgccgttcgtctccaccttgacgggatatccaagcttctctcctgtcctggacagattctccgccgccataaaggtatgggcgattccggtcggacatgccgttacggcaagaatccggtattttgcctgtcccgcatcattgctgccggtggcggcagtattattttcttcggcatccatctccgccgttttctccggtgagctgttcttcttatcgccgtcttcctttgcaggggcaaaacgatccgcttccttatcattgataagtttcaaaaactcatctgcagttttcgctttaacaagggcgttcttaaagtccggatccattaaaaccatggaaagcttcgaaagagcctccaggtgggcatcagcctccccgtccggggccgctatcatgaacagaagattggcagggcttccgtcaaatgattcatagtccacgccctccggcaccaccatggctgccagaccaggttcattgaccgcggcaacctttgcatggggaatggcaattccgtctccgacagccgtacttccaagggcttctctggccagaatacctttcttatatccttccttatcattcagcctgccgctcttatccatcaaatccacaagatagtcaatggcggctcctttggaatcgaccttcacgtcaagagcaatactttctttttttaacagatctgtaatcttcatgatgtcctcctgatttctccctgcttctcatgagcctttatttgtgacaattcagacagcatgaactgttactgcagcgagtgcgcagacctgtctgaactattacatttacatactattttcctgatggttacagcttctcaagaagttcaataatatcttttcttgtcgctattccctccgaaaatgcggttgcgcttccggatgccgttcccagcttcagagcataggcgtaatcccgtttgtcgagatatcctgcaatgaatccggccaccatcgaatctccggctccgaccgaattctttaccgttccctttgcaacacccatcttatgaacctctttctcctccgtgacaagaatcgccccgtcgcctgccatggatacgagtacgttgacggcccccatttcctgcagctttccggcgtaggttatgatatcttcatctgattttagctctgcaccgaacatttcaccaagttcatggttattcggtttaatcagaaacggatggtatttcagaacattgagaagcagatctttcgtagcgtctactacgattcttatcccttttccgtcgaggcgtgacataattgtttcataaattcggtcgtcaatcgatttcgggatactgccggacagcacgagaatatctccgttttccagcttctccagcttctcaaacagcttttccacatcactctccgtgatttgcggcccgatgccattgatttccgtctcattgtccgacttcatcttgacattgatccgggacatcccgtctttcacacgaataaaatcgcttgcaaatccaagtgtcctgacaccacgctctatctcatctccggtaaatcccgctacgaatcccagcgctgtgctggcataccccagttcctttaaaacagcagatacgtttatccccttgccgccgtaaaaaatttcttccgatacggttctgttaacggttcctgtcgtaaaattatccaccttcaccacataatccagagccggattaaatgtaaccgtgtaaatcatacgtcattcctcctcttctatatgaaatatattttcaccatctgacatcataataatacgtatctttcatttcgtcaatagatatcttcatgaaattccatttcttttccaatttcatcattatgcataatttaccctgaaaacctgcattttaaacatattttttttagtcattctgcccattgccgttttgacagccgccgctttgattttcacggctggctgcatcccgtctggaatagacacagccgcagtaattctgacgatacagatgatattcctgcgaaagctctacggagcgtctgtagccgttctttttcttaaaatctgaattgagaaaacggaccccgtatttttcccccgcttcctcgccaatccggttcagcctcgcagcatccttcatcggactgatggtgagggttgtcgtgaaccagtcaaatcccccctctttggccagctttgccgcctcataaagccgcattctaaagcataaggtacagcgttcgcccccctcttcgtcttcctcatgtcccttcgccatctgaaaaaattcctccggcctgtaatcacccgccacaaattccacaggatagcccgacggcatctccctgaccagacgccgaatctctcccagtctctcctcatattcatcgcggggatagatattgggattataataaaaaactgtaattttgaaatattcggacaggtactcaagaacatagctgctgcagggagcacagcagctatgaagaaagagggtagggacgtctccttcccgtttggcctgtgcgatgactttttccatctctagctggtagttctttttgttttccatacgttttcctccttatattacagccggaccgccgtaaaaaaacagcctgccgccaaaagccctatgtgcagtacataactgtaatacacaattgtccttcagcacacaggctgccaataatattcaactttactgattacaggaaatcacgaatccgtttacttctgaccggatttctcagttttctgagtgctttggcttcaatctgcctgatacgctcacgggtaacgttaaattctttccccacttcttccagtgttcttggatgtccgtcttcaagaccgaaccggagaacgataacctgacgttctctttccttcaaatctcctaacaatgcatcgatatgctctctcagcatcacggattccacattaccttccggagtcacaacgttgctgtccgctacaaagtcacccaggttggaatcgtcttcctctccaatcggtgtctcaagcgaagccggttccctggctatctgcatgatctccattactttgtcttccgacatctcgagtgcttcggaaagctctgctaccgacggttcataccccagttccagcgtcagctttctctgcatcttcgacatcttgttaattgtctcaaccatatgcacaggaacacggatcgtccttgcctgatctgccagcgctcttgtgacagactgccgaatccaccaggtagcatatgtactcagcttatatccttttgtgtaatcaaatttttcaacacccttaatcaggcccagattcccttcctgtaccaaatcgagaaagctcatgcctctgccggtataacgtttcgcaatactaactacaagcctgagattggcctcaattaaacgttcctttgcattgtcatcgccttccgccttcctcttggcaagacgcagttcctcatcagcgcttaaaagcggaactgtacctatctccttcaggtacatgcgcaccgggtcttccgtgccgattccttccagaaggtcaatcgcatcaagatcgatctcttcctcttccttcagaaaatcgtcatctgcatcatccagaagcagagcgtcatcttccgccagtattgtctcatcgattacttcagggataatgtcaatattactgttctccagataactgtatatctgttccatctgttctgttgacagattatccccggcaaaaaaattgttaatttctgtgatgtcaagtgcgttctgttttgttttcgccaggtcgacaagtcgttttagcttctctaaaaaattttctttctccacgaattaacgtcctttcgcctaagaagtttgtaaattataattcagtagcggctatccaatcggcttaattctgaataaccggttctgaacagctgcgtattgtaaattggtactcggccttttattatatactaaccaaaattttttttcaacatatttctaagcttttctcttagtttttcacaaagcttcgacaacagacgacgcccggcgccgaatcgacaccgcccggctcttgttttctatcagaatttccgttctgctgccgccgtactcgccgtcgagcgaccagtctaccggctcttgggaaatcactctcaaagttttggcccggaactgatatacgcagtcgttctctccctcgcgaagaatcagataagaagcaatacttgcaatatctttgggtgtcctgggtttacggacaagaagaacctcgaattcaccgtcgtccagggccacatcaaggccgaccagccccttaaatcctccaatactgatggtattggtaatcattccgataataaattcatcctccagcactttatcttcccattcaaatttcattctgtaagctttcagatttgtaactcttttcacggcctccagcatatatgcctgatggccgagaagattcttggcctcctgcggcgtactgtaagaaacctctgtgaatgctccgaatgccgcaacatagacaaaatatctgtcttccccgaatctgcccacatcgacggcagtcgttccgccgctgacagcatcgagagccgccttcttcatattcttcgatattccgatgctggacgcgtagtcattcgtggaacctgagggaatatatcccaggacaggcctttttccctcttcaatcgtcatcagtcccgatacgacttcattaagcgtgccgtctccgccgctgcagactacaaggctcctgcctctcccgcgccgtgatacgatctgcatggcatctaacggcttctgtgttacatacaccgacacctcatagccatatttcgtaaatatatccaatatatcaagcagtttactgcgtatctgctccttgcccgatctgggattgaacacgaaaatcatttttttcataggccttccctctcattatttcacattaaagcttttgtatacactccgaatgcatttggcaggggatattttgaaaatatttcctctttttttaccatatgaaacaattccggatgttcttttgccattttaacacggtatccagtcatatgccattccacatgagagaagatatggaccgagtcaggcagtctctcagaggcaagaatatcctctttcggaagcccgagaacttctgaaagctcctcctcccctgcatgtcccggaatattgggaaattcatagagggaagccagaagcccctttccactcctctttcgtatagcggctttatcctcccattcgagaagaaatattgtcttttcttcaattcttctcggttttttaggagcccttaccggaatcacatccgtcagttccccttttaaagccagacacagggaattcatcggacattcaccgcacagcggcttccctgccgggatacacacaatagcccccagttcaataagagcctggttataatcgccggccctctccctgtccatattatcccttattaaaagctcataacgcttctttgtgcctgctttcgtaatgtccccgcgatcagcaagcagtcttgatatcactctcaggacattgccgtccaccgctggttcaggtatcccaaaggcgatagatgatatggctcccgccgtatagctgccgattccgggaagcttaagaagcttatcataggaatccggcattacccctccatgctcatccactattacctgggccgccttttttaaatttctggctctgctgtaatacccaagcccctcccagagctttaggagagtttcctcatctgccgcggccagacttatgacgtcgggcagtgcctccatgaaccgtgcaaaataaggtttgaccgcctctaccctggtctgctggagcataatctccgaaatccagaccttgtaggcctccggttcttccctccacggcaggattcttctgttgttgtcataccagtgaagcagcggccctctgacagcccttaatctttcatcttctgttaaaggcgtatccggccgttccagtgtttttaatttactataaagatattccataatttcctctgcgcctcacaaaacgataacctgcacgctacgccccaaagccaggttttcgccgggacgaaagactcagtctcccccctcgccacaccggacatggtccgttccgtacgcgtcctccgggcctcaataaggccgggaacagtacgctgttatacatagccgtatatgccgcggacagaaacctcgcccgaaatcacctggtggactgccccgtcttccgtcttcacaagcaattcgccggcatcgttaatcccgagtgccgtacccacatattcgctgcccggctgaaggacacggacggagcgctgcatattagccagatggctgttgtagacgtccagcagccctgacatattgccggattccataaatacgttataatatttctcgtaagactccatcactgcgcctatcagctggctcctctttacacgctttcccgtctgcaaaaggatggaagttgccacatccttaatctcttccggaagctcctccatattggcgttaattcccatgcctgtaaccacgtaattgatgcattccagctcggtgctcatctcggtgagaatgccgcagattttctttccgtccgccacaatgtcattcggccacttaatctgagtctccaggccgcaggttttcccaattccttccgatacggccagggctgccaccagagtcagcatggaagcggcggacggatgaatctccggtcggatcatcaggctcatccagacgcccacgccacggggtgacgtccacattcttcccctgcgtcccttccccatattctggtagtcggccactgccagcgttccatgaggagcgcctgcctcagccgcctgcttggcttctgtattcgtggaaccggtctcgtcaaaatagagtaccttcttcccggcccatttcgtattcatactgctttcaatttcagccctgcttaatatatcgccggccatcttcagcctgtatcccttatttctgacggcttctatcagatatccttctgtctcgagctgcttgatcaccttccagacggctgttctggaaacattgaacttctcgcaaatctcctgtcccgatatatatccttctgcttctttaagcatacgcaaaacttctgtcttcacttgtttttacccccaccagattgtaagcgcactaaccacacaaagcaggaaaagtcccactcccgcggtcatcagtgccgcgcctgcaaatctctttttcttttttcctctgttattatgaaagcgatcatagccgttggcaaaattcagcaatgcggccagaagaaagatggccgggaacaaaatccggttctcatccggatttaaaaaagccagaactgccaggatgactatcaggattcccacaataacatgaagtgtgtctaaaacaaaagaagagactcttccgcttctctttttttcctgtattaccatccttttctctcctttaatgttttggtcgtgcattatcttcagatccttcttattttacataaataccggccgcttgtcaaaaaaatatttagttgtggttggaggacgcggccggaccggcggggtcctcacccgctaaaggaagtctcccttcagctttcagtaaagatttatggatttcccgggccagttcatccgctttgtaaacacggtatcggctgattttaaaagtaactgcaagctcctccagtattgccagatacatatccttgtaatcccaatccggcttcagcttgagctccctggccagctccgggaacacattctccgtataaaaacggtatccgtcgagataagcaagcgcctcttcatccaggacagattccagataaatctttaagagttccagttcagacatcatcctgtcaaaataatatggttcctcatacggggcatagatataatatctccgtccgtccaggccgtataggaggcgcgaggcctccagatacccaagcgccatattcttcctgcttctttttttgtcaaattcaagcactccgcccagctcttccctgggggcgatgtggtagatattggtcccttccggtatctttactttcttttcacggtcatagccgggtccgtagattcggactacgatcacgtcctgatagccacggtcaaccagcacatcgagaggaacattgttaaaaccgccgccgtccgtatagagctttccgctcagcttctccgtcttaaaaacagggaagaatgcgctggccagtaaaatttcctccatcttaccctctgatgcagatttgacgtctatattaaggagcttcatatcggatactgaaaaagtcgttgcaaacagttcacaatgggaattcctgatcttttcctcatctacggtttcatgaagcagctttttaagaggcgtaatatctactccgcggtctttaatcagtttcttaatttcctcggccgtctccaggatactgccggtgttcatattaaaatccataaccgcagaataattgatattatgccagatatcctccgctttctccggatcatccatgcaaatcagcgccccgttgagtgcccctaccgacacgcccgagacgccctttatcttgattccggcttccctgagcgccctccaggcgcctatctggaaagagcctttcgctccgcctccttccagtaccagcccgtattctctggataaatccagtttaatcttatcctggcccaggttgactttcctgaccatcctgcgccggctgctttccggctttttctcattctccattgttccacctgtacaggaaaaaccggattgcctcgagcatttcctaactgcctcggactaatccggttttctattattcctgctgcctattacgcgttgccgttactgtcgtccttcattccgacctctgcaagagactttacgaggcccgcaattccctgaatctcagagggaataatgattttagtcgctttgccgtccgctgccttcgcaaaggcctcaaggctcttaatctggagtaccgcattatcggctccggcctcccggatatagcggataccgtctgcattcgctttctgtaccttgagaatcgcttccgcttcaccttccgcctcgcggatcctcttctctttttctgcttccgcacggagaattgctgatgctttctctgcctctgcttccaggattaccgactccttctggccttctgcaaccagaatcgctgattttttctcaccttccgcacgcaggataacttcacgccgttcacgctctgccttcatctgcttctccatcgcatcctgaatggctgccggaggaatgatgttcttaagctccacacggtttaccttgatgccccacgggtcggtggcgatatcaagcgcggcacgcatctttgtattgatagtctctctggacgtcagagtctggtcaagctccaaatcaccgattatattacggagcgttgtagctgtaaggttctcaatcgccatgatgggattctccaccccgtatgcgaacagcttcggatccgtaatctggaaaaagactaccgtatcaatcttcattgtgacattatcttttgtgataacaggctgcggtgcgaaatccactacctgctctttcagaagaactctctttgccacccggtcaataaacggcactttaaaatgaatgcctacagaccatgtttccagataagctcctaaacgctcaacgacaagtgcctgtgcctgcggtacaatcctgatgcatgatgccagtaccagcaggacgataatcgcaagaatgacaaaacttataaatgctcccatatgctattactcctcctcaactttgcttacaatcaattttaccccattgactgcgtctatctttaccatagttccttctttaatcggcttcccgtcggacgaacgcgccgtccactcctgccccgacacaacagcggctcccgtagccagatcattatccacgtcggccgtgattctggctttcttcccgatgagtccctccacattggttttaaccgtcttcttattgacgaatctcagcgcaaagggccgggtaaagaaaagcagcgcacaggaaataataaaaaatgccgccatctgaacattataatttgctccgagtaaagccagtaaaaaagcgataattgcacctccggcaaaccagatggtcgtaagcgccattgttgcagcttctatccctatcagaatcacaaaagctgccagccagattatccatgccatactttcttctcctttcttaactaaaggaaatactccttgatactattatagtattttttcagacatttagcaacatatggcagaatattctaaacttacatttttattactcatttataaactaaaaactaatattttattaaatattaatttcttctctgccgtgcagtctcaaacatgagaatggaggctgccacagccgcattgagggattctacctgaccggccatcggaatcctgacatagcagtccgccatcgccgccgtctcctccgtaagtccgttagcctcattgccgatgagaaatcccgtatccgtacggtaatcttcattctcgtagcttaccttcccctttaagtgggcggcatagagccggattccctccgctttaatcctgccgagggcctgctgccaatcttccacatagacaaagggaacacggtagatagaacccattgtggaacgtatcaccttcggattataaatatcagccgttgcactgttcatgactaccccggtgattcctgcgccctcaccggcccgcaggattgttcccagattcccgggatcctggattgtctcaagaatcatcaggtgggcaggactgttcctctttatcccatcccctttcacaatttcattaagagaatgggaaagctgagcggccaccgccagaattccctggggcgtctgtgtatccgacatatatttcattacatcgtcggacacctcctcaaaacagatcccttgtaaaagctccgacgccttttcaccatgctgcctcagaaagctctccgaaacatatgtctccttcagcctgtccttcggcagctcggcaaacatctttgccccctccacaataaacagtccctgttccctccgtatctttgcttttttcgccagcgcagataccgacctcactcggttatttccggtactcgttatcatctgtgacctccgtaatgaccataaaactatatttcaatctgttccagctcctccagccacagcctgctgcatgcatcgcttggcatcctcagatccccacgcggagacacggccgccgagccgaccttcggaccgtcgggaagacaggaacgtttaaactgctggctgaaaaatcttctgtaaaataccttcagccattttaaaatcactgcattatcataaactccttcaaaagccatgacggcaaggcggtaaatctttcccggatggtagccgtagcgcagaatatagtacagataaaaatcatgcagctcatacggacctaccagatcctccgttttctgagctatatttccgtctttctcaggcggcagaagttccggactgaccggggtatccagcacatcgagcagtacctccgaaagctctttctccccgcaggtatcggcaaaataccttaccagatggcgtaccagcgtctttggaacggagctgttgactccatacatggacatatggtcgccgttgtaggtagcccagcccagcgccagctccgacatatcgccggtaccaatcaccatcccgttatatttattggcgatgtccatcaggacctgggtccgttccctggcctgggaattttcatatgtcacatcatgaacggaagaatcatgtccgatatcgcggaaatggtttgccaccgcatcctttatgtctacctccagaagggaagcacccagcttttttgtcagatagcaggcattgtggtaggttctgtccgtagtcccaaagcacggcattgtgacgcagataatcttatccctggcaagccccagcagatcaaaggccctgaccgtgacaagcagcgccagggtggaatcgagtccgccggaaataccgattaccgcactcctgcatcccgtatgctttaatctcttcttaagtcccatggcctgaatggaaagaatttcctcacaccttctgttcctgctctcctcatcctgcggcacaaatggggatgggtcgataaaacgctccggcctgttttcatcctcatacaggctaaagtcgataaatacataattttcccgccccgccgtctgataggtagtcattcttcggcgctcacattccaggcgctcaaggtccatgtccgcatagacagtctcattttcaaagcggcgcgattctgccagcatggtaccgttctcagcaataatattctgccccccgaaaaccagatcctgggttgattctccttcacctgcattggcgtagatatatccgcagagcagtcttgccgactggcccgagataaggctcctcctgtaatcgctcttgcctgtcgtctcatcactggcggaacagtttacaatcaccgtggctccggccgaagcatggccgatactgggcggattcagcacccagacatcctcacagatctctgctcccaccaccaggttctccacattggcacagttgaacaggattttgctccccatcagaacatagccgtcctcccagggaactgccaccggcttttcaaatcccggattaaagtagcgcagctcatagaattcagaatagttcggcaggcacattttgggaataagggcaagcagctccccgtcctgaatggcggcggctgtattatagagcttgttattatactcccacggaacaccggcaaataccagcatgtcgcttcctgccgtaaaatccaccagctttttcaattcttccctggcttttgtgagaagcggtttctggttaaacagttccccgcatgtatatccggtcagaaccagctcaggaaataccatgattttggctccgcgttcccttccctctatgattctgcagcagatctgctctctgttatattccacatccgctacttttacttccggtgttgacgccgcaacacggataaaaccgtccttcatattcattgtctcctttgcaggttatatgtcaaatcaaattgccattttattcaatctcttattttaaatacaatagcagaaaatgtcaatttattagtgttctcccggtaacattgttacagttcagcctctggccaaactgcaacaaatgatgcacagaaacggaaaaaagcgcctcgcggaatacatcatagccgaactgttaccttccattttccccatttcatataaataatatccatcagaatcgttgtaatccacgttatcggataacaccataaaacagcctcgtagcttggaaacaccggtattattaattttatgtaaatcattctgagcacgcacatgtttccgacggaaatcagcattgtttccatcgatttgcccgctccgcgcatgactcccataagaatctgatgtacagccagcacagcatagaatccgaccaggatacgcatcgtaatcatgccgttgtgaatcaccccgggatcggatgagaaaatggaaagcacacgctccgactcgaaaaacagcagcagagagatcagcgccgataccgatacgcagatgatcattccctgcttaattccttcccgaatccgctccggttttcccgctccgatattctgtccggtaaaagtcgtagctgccatgcaaaaactctgcatcggcagtaccacaaagccgtccaccttattatacgccccgaatccagccatcacggtggagccgaaaatattgacattggcctgcaccaccacattcgagagggagataatggactgctggatgccgcttgggatcccgaggcggagaatccgtttcatcatacgtttatctattttgatttttctaagttccagccggtaaatatcttttgtcctcatcaaagctgacataacaagtacggccgacacaaactgcgaaataatcgtcgcccatgccacgccgtcaactcccatatgaaaaccggctacaaaaaggagatcaaggacaatattggtaacagaagaaatgcacaggaatataagaggccgcctggagtctcccaccgcctgcaggataccggcccccatattgtataacagattgaacagcgaacccagaaaataaatcctgaaataaaggacagatgtgtcgagaacctccggcggcgtcttcatcagccgcagaatagacggtgagaacacgatgcccacaaccgataaaagaatgcctccgatgatgctcagggctatggacgtatgaaccgcccaccccatcttgtcctcgctctttgccccgtaatactgggaaataataacgccggatccgacagcaattcccatgaacattccaataatcaggttgataagaggcgtgctggaccctaccgccgccagggcttcactgccgatgaactgccccacaacaatggaatccaccgtgttgtaaagctgctggaacagattgcctatcagtaacggaatcgaaaaaataacgagctgtttccagattaccccctctgtcatcagaacactgccgtcttttttccctttcatcctactcactttttctccctccttattaatttcccctcgccgatgccagttccctgaccacctctccggcgatcagcagaccggccgccggcggaacaaatgcgatgctgcccggcaccgaacggcgcgagctgttctccgatatctcctctctgataagctgctcttccagctcaggctccggttccaccggcttctctgtggaaaacagcaccttcagcctttgaatccccctgcttttcagttccttcctcattaccctgcagagcgggcagacagacgtctccgatatatcagcaatccggaacagttccggatgcagtttattgcctgttcccattgatgaaataagcggtatccctgcctccccggcatactgggccagcgccagcttcgccgtcaccgtatcgattgcatccacaatgtaatccacccgtcccgccgccaggaaaatttcttgaatattgtccgtcagaatgaacgtttcaaaagtcatggtctgcgtatccgggcatatttccctgataatcccttccattaccttcgtctttttcatccccaccgtactgtggtaggcaacgcactggcggttgatattcgtcactgaaacatcgtcattatctatcagaatcagacgtccgacgccgcttctggcaagcgcctcggcgcagtgggagccgacgcctccgattccaaagactgccaccgtactttccctcagcttttccatcccgcttcttcccagtatcagttccgtccttataaattcacgtctctgtgccatatccatccgttaaacctctctactccatcggagcatgataaaacttgccataaaactgctccgtcttaaacacgttaataattacatggggatctacttcccgcatcagccttataatatcatccacctcataggaagaaattaccgtgtgaagcacatacatcttcttcctgctgtaaccgcccacagcctccacgcaggagattccgtgcttgcagacccggatatacgcctccatcatctcgtcggccttctccgtcgtaatctgcagagtcaccctgtcatacctgtggtggaaggtcgaaatcgtcttagtggatatgaactggaagagaatcgaatacgcagcgttcatccatccgaataacaagccgaatatgcagtaaagcacacagttcccgataaagacctgtccccagatggaacggcccgttttatttgaaacatagagggcgataaagtcggttcctcccgaagaggcattgcccttcagggctatcacaatggaaattcccattaaaaaaccgccgaatataacattcagaaccgggtcgtcaaacagcggttcaaaatgcaggaattgcaggaatccgctggtaaggaaaacctggaacagggaaaaagccgtaaaccttacactgatgccgcggctgcagataatcgccaccggaatattaatgcacagcattccgagtgatgtgggaaagcttattccccatgtagaggtcagcatttccactaagattgcaataccggtaaatccgccggacaaaagctccgccggccggataaaagcctgtataacaaaagcctgcaaaacagcagaaataacgactgccagaaatgtaatgacatttctgactgctttcattttctgtatctgcatggccctgtctttaatttcctgcgcttttctggctatctcgcctgtctccgcctctttatcctcttccgacggattatctgctcctgccgtattatctgtctccgccgtaatacccgtatcttctgtaatacctgcatcctctgtattatctgcttctctattttcaggctgccctgcggcgcctttgctttcgtacatcctgttgctctcttccgctcctaatcccttcttttcgatgtcttcggaactcattctataccttgtatgatgtttatagaagcaaaaacaacatattcctttcatttttcttgaactgtggtttaatacattcagatactgtggacttttgattttatcctgtagcttgactactcaacaggagtgtattgccgctacttttatctgaattgtttatagctggatgttgccggagtgtttcactctgagtacttatttcaatcaagtctacgatgataatcgttggtggatatcacggtatcggactttatgaaagggaggtacaacctcatgatttacgtaggcattgatattgccaaactcaaccatttcgccgctgccatttcttcggagggcgggatactcatcgagccgttcaaattctcaaatgactatgatggcttctatctgctgctttctaaactggcaccacttgaccaggacagcatcatcattggtcttgaatcaacggcacactacggtgacaaccttgtccgttttttgataagcaaggattttaaagtgtgtgttctcaatcccttatcgacttcggctatgcgtaaaaataatgtacgcaagacgaagaccgacaaagtcgacacatttgttattgctaaaacccttatgttgcaggatcctttaaggttcatctccttaaaggatctggattacatcgaactcaaggaactcggcagattccgacagaaaaccgtgaagcagcgcacccgtttaaaaatacagctgacttcctacatggatcaggtcttcccggaactacagcacttctttaagtccggtgtgcatcagaattctgtctatacgctccttaaagaagcgccgacaccgaatgatattgcttctatgcatatgactcatctcactcatcttctccaaacggcttcccacggtcattttggtaaagatacggccagaggattaagaattctcgcacagaagtctgtcggtatccatgacagttccttatctattcaaataactcagaccattgaacagattgagttattggatagccagttattccatacagagcttgaaatggcaaaccttgtcacctgcctccactctgtgatcatgaccatcccgggcattgggactaccaatggcgggatgatacttggtgagattggcgatatccatcgcttccctacaccgggcaaattgcttgcatttgccggattggatccgtctgtttatcagtctggtaacttccaggccaagaagacccggatgtccaaacgaggctcgcgtgttcttcgttacgctctcgtaaatgcagcacataatgtcgtaaagaacaatgcgactttcaaagcttactacgatgccaagagagccgaaggccggactcactataatgcccttgggcactgtgccggcaaacttgtcagggtcatatggaagatgctcactgacgaagtggaatttaacctcgaataagaggtctgcataccaatatcgatagattttgaaaaagcaccgttagggagctttattagagttacccttctttaccatcgattagaaaaatgaattttcgcctaatttatacttgacttttcatagctggtctcctgacggtaatttttatagttggcggtacaaagcgcatactgcggacctttcaccgccatgtaaaaaaaggaaccgcctttcccccacagaaggcagttcctccggtcacgttcactaaccgttacatcaaatagtttattgcttatgtaaatataacattttatactgtttttgtcaatcaaatcctgtcaatatgcacaaatcttttttgccggaggaaactacccgatattatatttgatttcctgcggacttattcactcataatttttagaaatttacacatactttccataattctaaaattcatttgcataattctggatgagaggagctattttatgaaaatctcaaataaactggagaccaatatgcagcgctttgaaaagctgctgcgtcccgatatcaactttgatgtggtataccgtgtcatccgcgtcggcggacggaatgcctgtatctattttattgacggttttacaaaggatgatacgctgcttcgtatcctccagtcctttgggagcattaaaccggaggcaatgcctgatacggcacacgaattttccaagctgtacctgccatacggcgagatagggctggagacggaggaagacctcctggtaacccagcttctgtccggcgtgccatgcatgctgattgacggatatgagcaggcattcaccatagactgccgcacatacccggccagaggcgtcagcgaaccggaaaaggataaagtgctgagaggatccagggacggtttcgtcgagactctggtttttaatacggcgctgatccgccgtcgtatccgcgatccgaaaatgcgggtcgagattatgaatgcaggagaaagctcccacaccgatattgccatctgctatatggacggaagagttgacgaggatcttctggctaaaataaaaggcagaattgagaaactccatgtggatgcccttaccatgaatcaggaaagcctggcggagtgcatttatccgcataaatggtacaatccttttccaaagttccgtttttccgagaggccggatactgcggctgcatcaatcctggaaggcaatatcattatactcgtggataactccccctccgcaatgatactgccgtcatccatctttgacattattgaggaagcagacgactattactttccgcctattacgggaacttatctgaggctgtccagaatgctgatattctttctgacgctgtttctgacgcctctgtggctgctctttatgcagaatccgggctggattcccgaatggcttgcctttatccaggtcaccgacgatgtccatgtggccctgatattccagctcctgattctggagtttgccatcgacggcctgcgtctggctgcggtcaacacccccagtatgctgacaacgcctctgagtgtcatcgccggtatcgtcctcggcgaatattcggttaaatcgggctggttcaacagtgaaaccatgctctatatggcttttgtcaccattgcaaactattcccagacaagctttgagctgggatatgccttaaagttcatgagggtgatgctccttttgctgaccgctttcttcaatctttggggctttatcgcaggaaccgttatcagtgtcctgtgcctcatattcaacaagacgattgccggaaaaagctatatctatccactggttccatttagcttcagtgaattaaaaaagcggcttgtgcgcaaccggcttccccatgaggaaaaaagagaatcatgattccactctctttgccaccacaaagaatctcccgtctttctgggtatactcacaggtggtaagcgtgataagccggtcgggccagacagcctccgctccggtatcataaaaacggtgaattttcaagtaattcatcagcttttcatattgctcctcatcttttgccagcagcatggtcttaaagtcttcatccagccgggaagccggctgcttgaaggctgcgatcacctggtaggttcctgtttctgccagcgtatcaaatttaacatagggatgggcttcctggaattcacggctgttgtatttttcgatttcggcaaacatatccccgtttttcatatgatggccataaatcagaatgtttggtgtagattgatccacccggcagtccccgtctatgaaaatcattccataggaggatttctctttgtcaaaattccggttgatataaaattccggttcgtctggggtatacatgaccggatagtccaccttcgtgccttcgatacgaatccatccctgcatatccggattctggtggttcagagcctcgtactgtgccagtctcagacgattctgccgttccttctcttccgccgcatcgaggcctgaatattcttccgtttcataaacggcagagtccatcacccggtagacatcttcaagggcttcctggccctttctgtaatccagctccttttttaccagcttatacccgagaaacagtgccgccgctatcccaagcagggcaatcagagtaaacacgtgctgcataaattttctgcccatctctttctacctcccaagcttaaaaagagcagcggttcttatccccccgctgctcttcaattaaaactgctctgtatttaaaaattattgcttttgaacactgtaacgttttttcatatagagtgcgccggctgcaatcagcagggccagcagaataccaaatatgtatccgctgatgccggtatcgcccatcctcgggatattagccagaggaactccggaatccaggatgacgatactgccgtcttctccggtccagggtgaaagtggaacttccgaatcaataatctctgtcacactgcccggtccattgttggagtttcctccgccggacgggccgccaccgcctccacctcctcctccgccgccggagggtgtggttccctcaacacagaagacccagtctaccgcatcaaaggtatcaatgaaatcattgtcaaaggtcgggccgggaagcttcagtgtaatcaccatattcttctgtgtacctgccgcaaagcttccgagagcaatgccgtaattaccggctgtcatcgactcgtaacccgcctttggcttcactccgtcggcgcttccctcatagataaccttatcgtcgagcttcagtgtcatctctatctgatccaggatatcgttacggaaggtcttgccgtcggcggacgccgtactcttatccctgaccgcggtcgttccgtcggcactggtaaagtcagcatatgccttcaggtaaatggtaacagcccggctgctcttattggagagcgccacctgattgtctatcgtatcacccggcatcagctccttcatgttggtgaagagatccttatcctggtatccgaccacgacatcggtatcgccggcgtatctgccactgccatttacatcaactgagtctgcagcgagtgcagtcatgctgctcattcccacgaatgccgccgcccagaagcccgccattatccgttttaatagatttcttttcatagcatcaaacctctctcgctgctaatcatggttatttggttttcaggcgctccccctaacagagggattcctgacctgaaatagcttttattgtgattaaacgaagagtattattccttggtctcaacgtcataactgatgatattaccactgcccaactcgaatgccgctttgcagcttgttacattatcgccaagattatcagactgtatagcttccgcgtccaaacgaactgtgattttcttatcagcaaaattctcgttatttgctttagccgggtcgattgtgatatccgtcataatcttctctgtccaattgcccggtgtgacaatatctttataatagtaatatccgtcatcactctcttcccagtttgaatttctaccaattatatccatatactcaggcttgctaatttcattctcaccctcaagaaatacaatcttagctcgaatatatgcagcatttttaccttcattcttaatacgagcctctttatctaaattctgtccaggtgtaaccggagtttctgttccaaactgtataccggtatatttgtcggtaatcttcttctcaacattcccgtcaccttcaaaccatgcaatatctacattgccggttgttactacgttcgttgccgtctcagtatctgtaaaccatgccagggttcctccaactgccaaagtaccaactaatgccgctgctgctaaggaaaggactaattttttcttcattttttatacctccgaatttttcatttaatattttcacaattcttttataagcttcttctttatctgttattactttgtcatcgccttccatgcatcttcctcagttaagttggcagcctggattgcctctgcatctaccttgatattgaaagaattatttgcaaaaacattatcccattcttcgcccggaatctgaatgtctgtaaacacggtgaaaaccacattctcgccattggtcatgatgttattggattcatcgtttttataatatacggttgtgctgtatgagccatcctcattcttggtccatttcgcattttcgtcgaggcctgcaaatttaatatcgttttccgctttctcatctccaaaggtagccataactgcctcgtctccgcttactgtaataacggctctgacgtatgcgtcattcccattatttttaattgtaactgttttctggaatttgtcgcccggcataacgtccgtatattctaagcctttttctatgatatcgccgtcttctccgccgtcttcactaagcgtaatatccacatttcccatcgttactacatttgttgccgtctctgtgtccgtaaaccaggccagagttccacctactgccagggtcccaaccattgccgctgccgctaatgcaagtgcatatttctttttcatctttctacctccaaataattttctatttttttatattataaaatcattattacttcctttttcagatacccgggcattcccggaataaccgtttccattcttacaggccgtttacaatttggaatgcctggtatgccgcatctgcgcctgtcgcaccgcccacatcgattccttcgacctgtacggcttcagatacaatcggtatagtcagcatgtcgaatgtaatgccgtccggcaattctaccttcccgtctctcatcaggccgggataggtaactgaagtcagaaactccacataatccccctgattcagcgtttccgacagataccagtatccgtcgtctttgcgggtccatactgcagacgtatcttccgtgtctgatgcgcgtgttattaaaacagacatttcgttgattgtattccatgctgcaatattcacaccgctctcattgccaggatatataatccaggcgcttccgtcctgcccctgcccttcgctgtccgtgtacttgtatgtcacggttgggatatccgccctgatcctgacataacattccgattttccggctgctctcactccgatgtcattctttgtaagcccatctaccttctcattaatatcgatttggattttaccggttgtgatactgttaaccgccgcctcaatatcggtaaagaatgcaatggttgtgccgattgtaaggattgcgattagcagcaatgccaaaccgaaatgcatcggtcttttcaaccacttaactttgtttttcacttgactgctcctcctccttttccggctttagaagctccggtatgatctgcagcaggataaatacaatgatatatgcgcctatacagaaaattcctttcattgtccgcatatagagcggaatatatccaaccattggcaccgacataccggcttttccgattacattttcaaatggaaccggggctaaatcttctacctcattggcatcgccttttgtcttaaattcccgcgtctcttcatttacctcgattacacggtgggtggctatcgcattatcacccttccggaaggtgatagggtcaccgaccgctatctcctccggggtgaaatgcttatctacgattaccacgcttcccacatggtaatatggctccatgctgccgctcatgacagcatagatatcattgcccattaccttcggtactatcatgactgcaccgatggcaatcacgataagtaccattattactgatataaaattacatatttttgttactgcctttaccatgatccctactcgcctttctatttttatttgccgcgactagttctcattgctgtcgtcttcctccgctttactgcttcctgtgaaaagaactgcaagcggaagggcttcacgtttcggaatgctgttgttttctgtcgggaatccaccctcgtctaccgtatttactttaaccttcacatctgtaaaataaccttcaccgctcttatagttgtggaattccaccttggcgtcagcaccaggctcagtcccaggtactacagaggcttccttggtatcatcaactgctgtatactgcaaatacggtatctcttcaatcacgtagctgcccaccggcaccttaatgtcttttgatgcggctgaactgttcgcatttactgtcaccgacgcatagaaggtttcttttgtatcagtatttgttaccttaaaggtaaatgtaaggtcgtcatctgcacttactaatgaatcagcctctgaatctgcaactatcatcttactgattctcagtattccagacttcactgtgactaaattcgtaaatgtaactgcctggttcttattaatctcctcggcaaaatcatatgtcattgtggcattggcactactcgccaactgtgtctttacgttgtccttatcaacacgttccacaacagctccggtacatttaacttcatactgagccggaatggtgtttcctccggtttctgttatctggtaagatgcaccattcggtattttagaaaatacgatttggtcaccaggcgccagttcaaaagtcttattaccttctgataacattccactctcttctccaccggtagctttccttgtaatcatgtatggaaccgaaagtatttctttattcttatctgtgaaaactgtctcgaactcaaactttcctgttatatccgcagagctctcggctaatttcttttcaattgtaagtgtcctgtttacgtatgaattgtaacatttcacttctaattctgccttttccgacagggtaaactctggtgattctttatttgagtcgctggtttttcccttagctcccactttccataatgtttcatccgaattgatatctccttcagccgtctcgataaacttaaagatatcattagcgtatttaggatgaatatttaattttacggaaccagctccttttattaagattctgttatcctgctctgcagaacctccagtgaaatcctggaattcctcccagccctctcctgtttttctcatcaattcaaattcatatgtctggttctctgccggcaagtcgctgccttcgggtacttttgttaaagttaaaaccctgatatctcccattttgtttctgtaaacaatctctttactctcattgtacctgattgtctgttccgcaatttcaccgttcgtgttgctgcccggcttgccgtcaattgttacggagatgtttacaattgcagaatcagcgctgtcgctttcagcctctctcaaaacataggagtaaccctcgggaacacctgtcaccgtcaatgtctcatcttttttcaaggtaaaccgaaatgccatttcctctgtatcccactcaattttaccttgatgctcgatgctgcccggcaaattatcttttacattcctgccttccgtatcttttaatgtcagataaaatacgtaatccggattaccttccggtacctctccggtcactttctttgtcacggtaaagccacctgttttcagctcaacggtatttgtaaatgtaagattgacctgagagctgccctgttctttgactgggaaacctccctctgcttttttctctcccgggttgatgcttacactgccatcatcaccagatgaactgattgccacagaataatcataggctgtatcactgattcccgtttcctccacctgatatttgctagcgtcatctaaaccggaaattgtacacatctcattgtctttcaatgcaatatcactaatttcataattattgctgtttatggtgacattcctttggccagctggcgtacttatctttattctttttccatcggaatctttaatagtaactttaaagtttgcagccaggttttccggtaaagaattgcctgtcattttttttgtaatctgcagactattagcggcgtactcatttgtacaaacaatttgttttccgctgtttggctctactttgactacataccagtcactctcaatatttccgtcaccgctccaggaagctgtagaaccatcattcgggttaacctccctgattctataccattttgtagatgtagtcgtaatacttctatcatatgtccctgccttgatactgatctttttaaccggtgtccagtcctctccgttctctgactcctgaacttcaaatgtgtaattcttagatgccgcctcttcctgtgaaattcctttcactgctttggcaatctgaagtgtcccctcaggaggaaccggtagccctatttcaatgtagcagtttgactctgttggatttctctccatatagaagaattcaagtgtataaaactgtcctttttcgataccctctatattataaatgttatctcgaagaattgtacctgagcctcctatttgaacgttattccccttctcatttaattcatatttattaacattgcctgaaacgcttgtagctccggatttaaaatcaatcgttcctgtagaggaaacatgcataccacctaaatccaaaaccagtctggagacaccttccgaatcttttaaatatacccatacatcgtcgtctcctctaaattcgaatgtcagcggtacacgaccattttcgtcaaagcaaccgtttgatggcaaaaagaatggaatgctcatgtgcataccgaacgaatattttttcgccgtattacttggataagattctgtattgaacggccagaagccattactacttccactggtcttcttcaatttcaaggtgttcttctctgaactgtctcttctgaccggtgttttgcctgcatcaaacacatactttgtataaccaccagaaacactctttgaagaaaatcccggaaaactaacattcggataccagcgaattccttcattaaatgcatcttcgtgcagcttatatacctcatattcatccctgatataagattcatcgacagggaacatcgttgtgtgagggccgaaatactttttgacctgtgctctgtgcgactcatccttataggtactgacagccagcttctgtacaagattattaaactgccatgcctgcccacttcttaagaggttactgcgtgatccgtcggcatataatgaaaacgactgttttaactcgttttctgagattccatcagctctgtaattactcagaatagctccattaaagcctacgtcatcattatttttacttatattatttccatatttcatgtcataataatcgtataaatcgactaccggcataaagcttcctgcggccatagtctgcaaatcacccagggacattatcatcatccctgccgatgcatccgcctgtttcgcgctgctccgtgccattcttagcaatgctcttttcttattctttacaagcactaccggataaacttcggacggaatatctacgccgtttatatctgaagaataaacttccacatcgtcgttgtactgttcttcgtcagcctcctcttcctcatcgtcatccccgtacatcatctcaaattcttcttccggactcttcggggcatcttcatcgtcatcgtcatcgtcataagaatcctgcggtacgaatgccatcacccgatccacgcggtgagaagaaattgaaacctgcacgtctccgccgcttccttccgaaccgctgtcggaggaactgcttccttccgaaccgctgtcggtcgagtcgcttcctgccgaaccgctgtcggtcgagccgctgtcggaggaactgtcacctgtggttacgtttcctgcagatccattatctgtggttccgcttccgctctccgaagaatttccactgtctgtatttccattatcagaagaaccgttatcttccgcacttccgccgttgccgccctgattttcctgaccgccggtctggctctcattgccctgtccttcttgattctggctgccgccggttccatttccatcctgtccgtcttccggctttgtctgagtttctccctctgccggagcgctgtctccgccgccgttattttctgtttcactgttattgccttccccggttccggtctgtccctcatcacctgtggaaggagtggaatctcctgttgtattgccggaatcctcttccggtccctgatttccgtcttctatcgttgtgtcattatctccattgtcctctgtgataccgcttccggagccgcttccactgccgccgcctgaacttccgccgggtcctgccgtatctccgccttcaattgcttcgccgccagccggtatctcaggaataattggcggtaactcttccttctcttcctcatcctctgacaaaagtacactcttactttcaacaagaactaacgcgctcttctttccgtcgatatcaagctggaatgttaaatctgcttcggaacggttaataaacagaaaaatgattttttcgtcgcccttcatctcgtaattctgtgtatcaacgatgatgtcgctggccgaagcttttcttaagttgctgtcagatgcttttaatgcgctgctcccgctggccgcttctgctgcctggccgttcagtttaacaaatacctgaagctccgcatccttgtgcatcgcgtcagacgcgctggccttatttatataaggtacatttttcaacatatagatactgccggtgctctgatcaaatatatctgaatatgcatcagagtctaccaatttgaccttctcttctccgtctgaactctcaggcagttccagctcctgaaatcctaactgtgcattatagagttcacctgaacggatggctgcttccgcctcagccttcaaagctgctccatccagttcaattaaaatgtctctgtcctcagcggtagaatctaaatccgcaaaagcgactccttgaaatgatgtcaaaatcatacaaactgtcagaaacatcgcaagacttcttttaaattttttcttcatccatttcatgctcttcacctcaacctgtttgttctctatccccaacgactaatcttcttccgtttccgtctttgtctgcatcttctcttcttccgaattcaatgcaccatctatcatctttatcagttccagtgcgctgcggaaatattgtttctttttttcatccgcccagacaacttcaccctgccaggtggcattttcccggaacattacattgacaatgaatgtgccttttatttttcttttttcatgctgtgcacccataaatatgctgttcctcctcatcccggcatttgtcactgttttaatagctctattcattcatatctgtactttaccaaatcatggatcttagaaactctcacaaaaagtgttttttttgttattacgtgttaatttatgagattttgtattatccatgtgccagtgtcgtctccgcattcccgatttcaaaggtactgtcaattaacttcagcagttccagaacacttctgaaacttattttcaggtttccctccaaccacagcatctccccctgccaggtggcattctgccggtacttgacgtagatgacaaaggttcccttctctccatgtttgttttcaatcctccgggcattatattctgcatctcttcttccctgacgcaggccggcatctccccgcttattattaaagcttcgcagtatggtagatttttgcggaaaatcccattcatcgtataaagcttccatatttcgcagtaattctgtcatatttcggaagcttctcggtttatcatcatattggtgccagaattttcctatatagtcgccattctctaccgtatcgatacagacacagattagattcggcgcaaaaattttatttatattctctttcatgtcataaatcacctcataggcaaattttaacaaatgggatctcatacgaaccttcacagaaagaaagaattttgttttttgacatgatttcgtaagaaaaaaacagatatgacgctataactggtatgctcacgcataaccatacgccatatctgtattaattgaagaaggtattacaaccggtgcgcgaagcgtacctgttaatgtcagttctgcctaagccggcagttccgccaatgaaataacattatatttaagttccgctctcggaccggacagctttttcatattccggctgatcctgcggtagatgatctgacaatcctcctgtttcgtgccaaccagcaggatcaggtactgggaattgttgtatttcgtaaaagcgtctccctggcggagactgacacgaatcgcatcgcagagtgcctcggagcgcgcttttaatttttcctgattctgaatcatctttccttcataatccaccaccgtacagagcatcagataaatagaacggccggtacgctccatattgcgtctcagcaggcagtaggcatcgataaagctggggtaagagcaatgatacgccccttcaccagttgtttttttagcgttttctgctaagtgattcttaatttcagacaggtcaccgggacagtattccatcttactgctcatttgggcgtaacacttcatcattttatcggaaggcggcagtcccatttcctcagaatagaagcgcgccgtcttatcatataaaacaaaagcctccctgtactcacctttgcagagcagggcatcgatctggtatacctgccactcatcaaaagggtagatctctgcggccctggaatatatctgatacatggtattgtaatccttttgacgtttcagatattctcccagccattccgtacatctttcgaacatattcttaaactgtaaactctccgttgtaacccagatttccgtcgaaatagcgggaagcagttctcctttatataattcaaaagcggttttataaacctggaatcttgcctcttcgtctgcttccatatcggctttttctatcagagaacgaaattccagcgcatccacccggaccggcagtttcggatccataacataatatccgccgtcccgtatgatataatcaatttccggaagtccgagacgatgcatatgtttacgcatctggtatatcagattatagaagctgttattcagattgaactggctttccctgtcataaagagcctgtatcagccgatccttgggtatccccttcccgccctgcatccagacgagctgcaaaagctgaataaactttgccgtgttgtttcttcccagaacatagtcttttccttcataagaaagggaaaaccctcctaacatacgtatctccaaaacaccgttaccagaatttttcacttttttcatctcccccgtttattacgtactgctttgccaggtaattctgcattttacaccaccgctcctatagagactttcccggaggagactgtgcagccaaaatctgtccagacagttataaacataaatagaaaaatgctgaatatttcttttctgttcatcagtaatacaacataatactgattatgtggtattattgcctacaataagcttatatcccaatttcaatataatcttattataattttcctatttggtctatggttattatatcaataaaggactctaaattcaatgttttaatatgttgtacaataatcttcgtcaaaatcaagagagttcctccattgaaatatgaaatcatatccaaattaaaattttaagattatctttaatgggaaaagtgcgtctatatgattggtaaatttatccctataagagtaaaaagaatggcatatccatttgtatcttcacttctattctgctccaccccctcagattggcggagttccccctaataacttcaatcgaacatgcaataataccacataatcagtattatgtggtacatcataataacaaattcattctctctatctgtttcctgtgttcacctcccgaagagattatatagattcttgtcgtattgatattgctgtgtcctaacaaatccgccagttttgctatatccttttccatctgataaaaggaacaggcaaagaggtgccggaggttatgaggaaatacttttttctcttttatccctgctttgcggcatatttttttcatttctttccagatgttgctgcgatcaatcggatttccctgttttgtcctgaacaccggaccgctgcggatcttctctttctttatataatgcattaacttcatcgtaagttttttcggcataaggacctgccggctttttcctttacaatcaacctgcactcccccatccttcacggcctgtaccgtgatactgggcagttcgctgattcggatccccgtacttccgattgtctggataatcaggcatatcctttcttttccctctcttttggccgtccggatcagttcaaaatattcctgccggctcagttctctttcctccggacaataaacctggcgctgttttttaagctgctttacccggaattcctgccatccggcaaaaaccataaaatgattaatggatgcaagaattgaattaacgctgttgagggcgtaattttcgaccagatattctttaaaatttatcacccgttcttttgtcacctctccgccattgataaaatcgataaattttctgagatcccgacggtatttttctattgtatgtctgcttttttcatcctgctccaaatgttcacaaaataaatcttccattttggcggttataacgttagccatagtagtcctcctttaatataattatcgaaacggttcagccccattaaccgtgcttcacaatttccatctatcttatcattaattgaagtatatattaagagattacgcttacatttaaccggtacttttttccatatttcttcccttgaacggcccctcaggtgcagagatttgcagctcagtttccgcggcgcacctaaaaaacatggagaatggctgccttgcgttgccatcctccatgttttctctatactgtctattttctcaatattattttgcgaatcccgcgggcatgactcttgcgagcgtgattctttcttaatttacaggaaagttttcctgaaattctcaggccagccagcacacatcgatgtaaatccgcgacacagctccgcggttctttcctatatgaatcactgtttgatccgctgtgtcgtattcaaaccggatccggtaacgtttctgcacgttgcagagcatacagcagtcttccagataataccggctcccgtcctcctccactacttcgctaaactgataagcctgttccactttcctcccggaatctccaaccctgattttactgaccggcaggcatatgtcttttccggttatctccaccctttgcagaaaagaattgtctccgtttaagtagaaccatgccctgaaaccgccgtaatcaaccgtcaggttattgtcttctctctcttccttcagcggctccccgtatatatttaagaaatctttgtagcagtcaggaaaaatcttatccattccgtcgtagtaaatctttgagcttctcaggcattccacggaatggccgggataactgtcggacaaattcatgacaaattcagccggtgacggataaccaagccatctgaaataagaaaaagtatgaaacgacacctgacagataaccgcggctgcaatcagtattactgccacagtctttgccttatccccaaaaaggcagagggaaaggtaaagtattaataaaacaataaagagccactgtaaaaatgagaaaaacattcacttcttcccttctcatcagtatttattttcaatctatgccgccttgcttaagctcctcatgaggtacctgcggttatccaaaaatactgtcgtacagctccgtgagcgcctcctcataatgctccgtccccaccgtcgcacaggaaagaagaattctcgggttcatactctcccccctttttccctcctccggaaccacggcgcggacagcgattccggcatgggccgctttcctggctatctcttccgaagtaagctccgtccggatctccgcaagtaccagaaatccagcctcccccagatggggaactgccctgtccccgaatatcctgccgatatcctcacaaagctttttcgccttggcggtgtacagttttctggctttgcgaatctgactctccaggtggccgtccctgatgaactggcagagtgcaatctgctccgtcttggacgatgtctggttataataacggctccgctccctgtataccggaagaagctccggcggcagcaccatgaagctcattcggatggagggaagcagaagtcttgaaaatgtccccagatacacaactccgcgcccgcctgccagcccctgaagggatggagtcggcctgttataataccggaactcgctgttatagtcatcctctataatgaggatgtctttttcaaatgcctctttgagcaaatccatccgctccgtaatatgcatcacctcgccccataccgtcatctgagaaggcgtcaggtagcagatgctgccggaatccggtcctcccgcttccctggcgctgcgcatccccccggtcctgaactcgaagtcctcaaaaatcgtacgcccctgtctgaaaccaggattgtaaaaatatgcattcttcctgtccctcaccatcggacagaggatatgcagaaggctctgcacacccgcccccaccacaatatgctccggagtgcagaccacacccctgtggcggcccagataactgcagatagcctcccgaagctccctctctccctgaggctcgccgtaggataaaaggcgctcatcctggcggagggaacttttaatatagcgcctccatagatcgaactggaagctgtcgcgatccacgttggaggatgcaaaatcataacgtatcttaggcccgtccgtctctttgccgcccggcttccacgcttcccttgggccggaattcagtatctcagtcacataatagccgctctgcggacgggacaggatatacccctccgccgccagcagcatatacgccgtctccaccgtggtcctggaaagctgaagctgcattgcacatttcctgatggagggcagccttgtccccggctgcatctttccggaacagattaaatctttgtaatagttgtaaaccctcaggtaaagattaagccccggatcgttcaaatctaacttcatcttactgccagccctttcttaccgtcggccagctctttcatctccctcgcgttctgccttaccgtctccgtaatctcggctccgccaagaagtctggccagttcctccgtcatctgctccctgtcaagcgggcggatcgttgtcgtcgtccggccctcctccaccgattttcttatttcaaaatggctgtcggccatggcggcaatctgcggcaggtgggtaatgcagataacctgatggctccgggcgattacacgaagcttttccgaaaccatctgggccgtccggccgctgatcccggtatcaatttcatcaaaaatcagggtgggaatatcatctgtctcggccagcaccgttttcaccgccagcatgatgcgcgacagctcaccgccggaggcaaccatgcccagaggtctgaccggctctcccggattggtggagatcataaattccgcttcatcgtaaccggccggagtaaaatggcttaaccgtctgaattccattgcaaacttcacatccaggaaattcagttccttaagcccgtcctcgatcttgtccgataattcaccggcaatctcctgtctcagcttagacagggcggccgacagttcttccagcctgtcttccgatgccttaagctccttttccgtatgaaggcggagtaaatcatagttctcaagctcctccagcttcttctttttctcttccaggcttttaaggacatcctcaatggtctttccgtatttactttccaggtttcgaatcagatccaggcgttcttccacctgattaaaggaatccccgtcaaacgtcatctcctccagatgggcggaaatctcccttgtcaaatcactcaaaagggaatccacatcatagagctggtccctgatgctcatcagctcctcgtcgtactgcatcgcatcgtccaccgcccttaaagcccttgaaatctcatccgtgctgacggcttcatgggcaagagcaaggctctccgtgatcctcttggcattcgaaaaccggcggtaaaccgactggcattcctcctcttcccccggttttaaatccgcattctcaatctcgtcgatctcaaaacggcagaaatccatctccctaagcctctgctcctggttcagattcagcgactccagctttttcctgagttctatgtatgcatggtactcttttgcaattttttgttttaaaccggcagtccgggtttttccatattcgtcgagaatctccagatgtctggcatgatatagcagagactgatgctcatgctgcccgtggatatcaatcagaagtccggtaatttcccgcagcctggccgaggtcactgtctccccgttaatcttgctgatacttctggcaggcatgatttttttagaaatgataataagactgtcatcgtccgggtgcacatccagaccttcaagttccttccgttttttttcgtcggtcacggaaaagaccagttccacataggcgctgtcacagccctggcgtatcagatccttcgacgccttggcgcccagagccacattaaccgagcctataataaccgatttaccggctcccgtctcgccggtcagtatattcagcccgtcatcgaactccacttccgcagagtcgatgagggccagattcttcacatacagatgaaacagcatcccatcaccccttatccagctatgagcttcttgatcttatccatcaatactatcgtgtcatccacagtccgcacagcgcacattaccgtgtcgtctcctgcgatacagccgacgatttctccaaaatgcagggagtcgagagccgcccccaccgccatcgccatgcctgacaccgtcttgattaccagtatgttctgtgccatatccatggaaagaaagctgtcatggagtattcggatgtatttgtcattgaatgccgtctgcggatgaaataccgcatacttctggcgcccgttctccgtctggatcttggacagcttcaattccctgatatcacgggatacggtggcctgggtcacgttatatccctctttgttcagatattccgccagctcttcctgcgtttcaatttcatatttcccaatcaactctacaatcttgctgtgacgttccaatttcattaaactatcctccgctctgatacatcattctgtctgatacaccttgatacaagctgcctccggatatccggcgcattctgataattactctgtctgataactgccgcgttacagttcagccttcggccaaactgcaacaaatgatgcacagaaacggcaaaaaacgccgtttcgcgccgcttaactcgggattttcgcaaaagcagcgaaaacacctcgcggaattcatcatggctgaactgttaccctgccgcccctatatatgcttcatctttttcctgatattctcaagaaatgaaacctggctgagctgcaccagcgtcgttgtgatttctgatcgctccacctcaatccggtcccctcttctaagctttacaaccgcatcgccgtcaaagcttaaaaactgttcgcgatcctctccccctgttaccttcagcataatcctgttttcggaagagagaacgatactcctggagttcagcgtatggggacagataggggtcatgatgatcaaatcggattccggcgccgcaatcgggcctcccgccgacagattataagccgtcgaaccggtcggtgtagccataatcattccatcagccgtatattcattaaaaaattccccattgacatacagatcgtatttcagtgtatgaagccccattcttcctaatataatatcgttcagggcaatatcctcggctacggttctgccgtctgaaatcacacgtccctgcagcatcattctgtgctccagcctgtagcggtcggccagcagatcatccatggcagtcaggatatccctctcgcagcaaatctgtgtcagataaccgagatggcccatatttacaccgaacagcggcagatttctaccggccagatccctcgatgcctggatcagcgttccgtccccgcccagaacaatcacgcattccgtctcctggggaaccttccggccgtccgtatagcggtactcggaggtgtccggcggttcctgatcccacaggcattcgcatccctgccgggacaggtattccgcaatcatctccgcacccttttccgcattttccttctctttattcacaatcagataaaaatgtttcattctgcgctctcccggcatcatgccatcttaccggactctatttatcaagctcgctgtgagccgcttccacaacctgagccgggtctaccgttacgttatcataatgttctccatccctgtgattctgaaggtggagtaaatattcgatgttcccctccggccccttaattggggaaaattccaggttcagcacctcaaaaccggcctccacggcaaaatcaatcaccatgttgatcacttccagatgggtgcttttctccctgactacgcctttctttccgaccttttcccttccggcctcaaactggggcttgatcagacagacaatctgtccgtcctccgccatcagcttcttcaccggaaccagcactttggtcagggagatgaaagaaacatctatggatacaagctcaattttatcattaatatcatccggtgtcacgtaccggatgttggttttttccatgcagacgacacgcgggtcatttcgaagcttccacgcgagctgcccgtggcccacatccacggaatagacctttacggccccattctggagcatgcagtcggtaaagccgcctgttgacgcccccacatccatacagacctttttgtctgtcaccacaccgaaatggatcatggccttctctaatttcagtcctccgcggctgacataccggagggttgctcccctcacctcaattttagccgtctcctcaaatgaggtgcccgccttatcttctttctggtcatccacatagacgatgccggacataatgatcgcctttgccttttccctggactctgccaggccctttttgacaagaaggacatctaaacgttctttcatctgttttcctccgaacccggaaattcactcttcagttcattctttaattttatcaggatggaatcgctgtcaattcccagatcgcttctcagcttggatacattaccatgctccacataggcatccggcagcgctatattcaccacccggatggcgggataatgcttctgtacataatcggtaatccgctcgccgtatccgccgcggagtacattttcctccagcgttacgatacagcggtggttcctggctaaataatccaccacatcggtatccacgggcttgataaagcggccgttgacaagggtgcaggaatgcccctcctctttcagcctcgtccgtatatgttccgcggtgctgaccatgcttcccacagccagcagcgcaatcgaatcttcatcgtagagaatctcgctctttttatattccacgggagccaggaactctttcagtcctctgtatgcctggcctcttggatatcggatcgccatcggtccttcatagtccaccgcaaattgcagcatttctctcagctcccagagattcttgggcgctattacactcatattcgggatcgacgacagatacgtcaaatcgaaaatgccctggtgcgtctccccgtcgcttcccacaagtccggcacggtccacgcagaacagtaccggcagattctggatacagacatcgtggactatctggtcataggcgcgctgaaggaaggaagaatacaccaccaccacaggcttcaaaccggctgccgccattccggccgccgatgtcaccgcatgttcctccgcaattcccacatcgaaaaagcgctgcggatacagcctggaaaaacgctttaagccggttccgtcgggcatggccgcagtgactgccaccagcttttcattcgtctcggctatcttgcagatttccctggagaatacatccgtgtaagacggatataacttctgtcccagcggttttcccgtctctatgtcaaaaggctccacgccgtgaaagctggacggatttttctccgccggcctgtagccctttccctttttcgtcatcacgtgaatcaggacggcatggttaatcttctttgcctcactgaaaattttggccagtccctttacatcgtggccgtcaaccggccccaggtaggtgattcccatattctcaaaccacatgccgggtatcaggaactgcttgatgctgttcttcgtcctgagcagggtatccaccaaatcattgcctatcatcggaaccttcgccagagtccccgccacattcttcttcagcaggttgtagccttcgtcggccctcagattgctgagataccgggaaattcctcccacattctcggatatggacatcttattatcgttcaggacaatgataaaattcttcttcaggcgcgccgcattattcaatgcttcatacgccatgcctccggtcagtgccccgtctccgattacggaaacgattgaatactcctcgcccagcacatcgcggccctgggccatgccaagcccggcggatatggaggtggagctatgtcccgtatcaaaagcgtcaaagggactttccttacgtttggggaaaccgctcaggcctccgtactgccgcaggccgtcaaaatcgtccttccttccgcttaatatcttatgggtataggactgatgtcccacatcccagataatcttatccttcggaaggtcgaacgccagatacaaagcaatcgtaagctccacaacgcccaggttggaagccaggtgaccgcctgtatggctgattttttctattaaaaacgagcgtatttcttccgccagctctcttaattccgtctcattaagcttctttacatcatcgggtccattaattttatctaaaatcatggctttttccttctatattaattacggttcacggccatagcccgccgctgtgcggcggagctgtgaaccgtaattttatttttctctgcttaccagtacctttatcaggtcctccaggaaatcattgcttcccgggagagaatagaggatatcgacagccgtctccgataatttttccacatcgcgtttggctttctcaatcccttccaggctcacataagttgttttattatttttttcatcgctgagaaccggttttcccagcacctcctggctgcttgtcacatccaggatatcgtcctggatctggaaggccagtccgatggctgccgccatccgctccaccgtctcacactcttcgtcggatgcgcccgccataacggcgccgatcaccattgccgcttccagaagcgcgcccgtcttcagccggtaaataaagtccagcttatcctttggaatcagcttgtccgtcagctccacatccacagtctgaccgccgatcatgccgtaaattccggtcttctgtgccaatatcccgatgcactttccgactctctgcgcattatccgtcatctggaatgccctggcagccgtctcgatcgcatagatgagcagggcatcgcctgccagaaccgccatatcatagccgtaaaccacccaggtagtctttttccccctgcggtactcatcattatccatacacggaaggtcatcgtgaatcagggaagaggtatgaatcatctcgatcgcagccataaaaggttctatctctttgcctgttcctccgaaaagacggtagacctccctcatcagcagagggcgcagacgcttgccgcctgccttgacgctgtaattcatcgcctcaaaaatagtcttctgatggccttcctccgccggcagatacgagtaaactacctgttccacttcctccgtactttgtaaaagctgttcgttcatcactatctcacatcctccgtgttattgccattcagcaccagaatctgcttttccaccttgtctatctttccgccgcaggtttttaccagcttcattccggcctcataatatttaaaagaatcctccaatgaaacctcaccgttctccagatttctgataatgccgtccagctcggtaaatatctcctcaatggaaagcttatcagccggggcttcctgtgtttcccccgcctcgttcatcactgcttcgtctttttcgtttctatccatttggctcaccattctttttatcctctttattatataccacttttctcagccttcaccacttccgcttcaatccggccgtctaagacgcgtatcagcagatgatcaccggctttcaccgactctgccgattccaccctttttccgtcctccccggtaagaaagccaaaacctttgctgatcttctcaagaggggaaaggccgtggaggcgtccgcttaaaagtgccagcctgtgctttctgtcggtcagcttctgtttcagcagccgttccatcctctcctcggcatcggccagccgctgacgcttttcattgagctggcgctccggattatagagcctcagacgcagcctgtactgctcaagccggtaggccgccatctccttcctgcccgacagcgcacggtaaagcttctgtcctgcttccctcaactggccttcgaaaagtgcataatcaaacactgccagttctgctgccgcggagggggtcggcgccctcagatccgccacataatctgcgattgtcacatccgtttcatggcctacggcggatatcaccggagttttgcaggcaaaaattgcccttgccactgtctcctcattaaacgcccataaatcttcaatggaaccgcctccgcgtcctacgatcagtacatcaagccccatcgcatccaaggtctcgatccccctggcgatactggacgccgctccttctccctgcacctgtgcggggcatagcaccagctgcacgtagggattccgcctccgggctatatttatgatatcgcggattgccgctcccgtactggcagtcacgatacccaccttcatcgcgtatttcggaatcggacttttgtattcaggggcaaacatgcccatctcttccagttcatttctcagcttttcgaaccttttaaacaggtcccccgtgccgtccagtgtaatctcggcggcataaagctggtaccgtccgtccctctcgtacacctcaacgcttcccttgacaaccacctgctgcccttcctccagcacgaaattaagcccgcgtcttttcccggcaaacatgactgcctggatagcccccaggccgtccttcagtgtgaagtaaatatgtcccgatgaatggtacttgcagttcgacacttcccccttcaccgagatacggctcagggcaaaatcctgggcgaacatattcttgatataggcattgacctgcgatacggaatatacacttgccgctcttgccatagcctacaccagcttcgccagaatcccattgacaaatgagggggagtcgtctccgccgaatttcttcgccagctctaccgcctcattaatcgccaccttctcgggcacatcctcatcatactggatttcaaagagagccaggcgcaggattgtaagctccaccttgcccatcctctttgtcgtccatccctttgcgatctcattaatccggctgtctaaatcaggaatcttctcgatgatacgctccaccttattcgttacataccctccgtcaaacacgtcaagggccgggctgtgaaggatctcactctctccgccgggggcgcttacctcctccaccggctcggtaaaatactcttccatctgctccttcgtctcgccttccggataaaagtcagcgcagaacaatagtttaaaacaatgctcccgcaattctcttctggtcatttcatgtcctcctgattctatcaatttatcctttgtatctgccattcacatctgtcctgacggcagtctcataaggcggtaccgccaaaaatcggatattattctaatttatcattataacgtaagatgcggaatttcacaaggggatggaaaatagttttccactttcaaacagcgaaaacacctcgcggaatacatcatggctgaactgttacactttctattcttccctgttttttcctgttttttcaactgcggggagaaaatgttgagggaggacgcgtccggaacggaccagatctggtgtggtgaatgggattggctgagtcttcagcccctgtggggatgttagtccaatgtcatgatgttggggtcaaaaggtcttttgacccctttgataccggattgctccgcactgcgtgctctcacaatcctcaaaaacattcgcaatccgctcatttttctgcgaaaaatggcttcttactcatgtttttggcgggtcccaagattaaaaatcttcatgcaagcaagcttgcatcagatttccaaccttttgaccctggtatcatgtcatgatgttgcccgcccgcttgccgtactgacattgcactcttttgagtttgcagcagtgctaagcccgtggccatacttacaaaaaacaggcgcggaatttatttactcaattccgcgcctgttttttacctcgaccggtaaacagccagctccttatatcccgcgatacctcagcctctccattgccgcaatcaaattttcctcctgttccggagtcagattttccatcggcctgcgcatcttagtcgtcgcaatgattccgtcccgttttagcattactttgtatgctgcaatattattgttctcgcagagcgtttcattcagaagatttgtcctgtgctgccatttggccgcttcctcataatttttctcctggagaagctgccatatcttcttatagtaagccgggataatctgggcgtttccggagactaccccgtcgcctcccatcgccgagacggcggcaaatagatgatccggcccgaccagcacgctgaactgccctccgtttatccgaagcatctgctggatacgcgtcatatccggatagctgtacttaattcccactatgttgggacagagccggctgcattcctctgctgctttgggacttatgtcattcaccgcacactgcgggatcgcatacaggtaaaccgggaaatcctgcgggacgctttttgcaacagttgtaaaataatcaaccagcccctgatccctgacggagaaaaaggcaggtgtcacaactgcaatgccgtctgcgccgatttcggccgcatgttttgccagttccaccgtatccctcagattccatgcacccacgtgtacaaataccggtactcttccagctgcatgccgcacaactgtttccgccaccagcctgcgctcctcaaccgacagatacatcatctctcccgtggttccgcatgggtagatagcctgcatgctgctgtcaatacagtgatcggccagcctttttaaagacgttacgtcgatcgcatcctcctgcgtaagaggtgttacgatcggcactacaaccccatataactttttcatccctcaatctctcctatctttacaggacggtgctctgcagcacttcgttctacggccagagccagtttaagcgccatcaatccgtccgcatatcccaccggcggctccgttccattcagaatcgcgcctgcaaacgctttcacgcactgataatttccattgatataaaaatccttcatcgccagttttccgagatttgagtaattgggccgcataatctcaaccgggacggctgcttcaataaccgcctgggtgcccttattttcaaatcccgcctccggctcccgtatcctcgaaggcttctgccaggtaaaatcacgcccgttttcagcgctcaccatattccggtcccctctcacttccacgctctccatcccgtatccgcatacccaggagcccagcgcgccgaatgtcatgctggccacacagccgttcacaaacctaccattcactgcaaacatatgctgccccggctgtttctcatatttgtaagcatatacctcatccagttcgccgatcaggtatctcgccaaatcaaaaaaatggcagcagccgacgcggagaagatctgtttcgttggaacggtatcctccgataaacttcgcaataaatgcggatggggcgccgaatccttccgactcaattgccagcttcatatcccggtaggccaggttgtaccgcttattgaaggaaacgcctattttcctgtgatgttttgcggccgcctccttaagcatcagcagatcgggcagctcggtgccaagcggcttttccgtatacacatgaagccccgcctcaatacactgcctggccagagccgcctggagccctgcaatggtaatgataaaagcagcgtccgcatccacctcgtcaagcatacggcccgcatcctgataagaacgggacagccccagccgtctcgcagcaaaatcagcccgttccttatttttatcgcagaccgcaacaacttcgatttcatccaggtaagatatcgcattgtggatcatgttgaccgcctgctccccgcatccgagcagcacggcgcggagtttcttttccgctttttctatcccctcatataaatacatacaccttctcctttaaattgccgtaacggcagaggccaacgcttaccgcttcgtttccaccggaagcttcagcacaatcttgcggtacttttccccttctttcccggccattccccggcacctgtgggcgtcctggggaaacagaatatagaacatgccctctgtggcaagaattttctttccgcctcccctgtaaaacttgaaatccgtctccggatcgtattccgtctccgcttccagctcagacgcttcctcccactcaaatgtctcccgcccctcgaataccatctgcacatccagatatttttcatgtgtctccatccggtctttgccgatatcggaggtcactccgatttgaaccatggcgtagataccatgctccgcctcatagcggccttccggcttatccaggagcgtattgacaaacgtcatcccttcctccagattcgaaacaagtgaattatacatccggtagtttttcatataatcaagtatcatctcattctcctcctgctgccctgttactatccacagccacgctgaaaagcgcggttctgcaaacagtaacccgctttcttaattaatacgagaggcctgccaggtcaaacgctctcattaaaaatccgcggatgtccctctctctctcccagagtgcgtctcccatatggctgcgcacttccacggctacgtgggtgtttgttattccctccgccggatttccctcagcagcacgttttaataaaccggcggctatctcaggagtcaggtatccccaattcttataatgtggggctctccccacctccatatgaaaatcgccatagtatggatgagacggttccgtcacacagttgcagatatgaaactgcgccatataaggcagggccgcctccagcgattccatcaggccgatgcctgcaagagcctcatgggcgctgtcccagtgcaggtagaaattgggacaggtctttttaagcacgccgaaccattccgccacctcatggatcggtcccatcagctgtttcttgtgtacataccgatccagcggctccagcgtcagatgcaggccgtcatattccttcgccgcctctgagatacggcaataggaatcaaaaagcgcttttttcgcctcttcccgctttaaatcacccggatcatctcctgatggaaggccgacaatcgcagttccggcttccgctgcaattttcataagctccaccgcgtaaccgaccgattgtaccctcagctccctgtccgtggaggacagattgtatcctctttttatgatatcaggcgatgcccactcggtaacctggtagctcttttcccgggcaatccgcctcaccttggcaatattctccttctggaaaataaccggcagttcaattcccttgtaaaaatcaatattcttcacttcctccagcatcccgacgagaaaatcctcccggtccgccaccggcataaagatttccagcaaatggatggatggcaatatattctgcatctgttacctctttcttataactttttatacgataacctgcacgccccgcgcacaggtcaccgccatcaataaatgtttccttcattcagactgcctgaatgcctgaactaccgctagcttttctttttccttcccttaaattcactgattacgggccagccgattgccagcagaatcagtcctaccagaagcatggagatcggtgttgtgaaaaggcgcatcagactccctcccgacagcatcagagtacgtctcagattcgtttcgcacatgcctcccagaagcagccccagcaccaggggccccagcgggtagtcgaacttgcggaagaaaaagccgaggataccggcaataaacatgataattacatcaaaatagctccggttcagcgagtaggctccgatacagcagattagaagcaccgccatctggatatactcattttttacgctcagcagcttgatacagacctttgccgagagcagtcccaatggcaggataatgatgttggcaagcagcatgatgatgtacaggcggcagacgaagtcgctgcttttactgagcagcgtgggacctgtcaccattccgtacatagtcagagcgcccagaagcacagccgtgctggagtccccgggtatgcccagtgcaagggccgtggtcaaagcgccgccaatcgacgcattgttcgatgcgcatgtcgtcgcaagaccttcaatcgagccgtctccgtattcttccgggtgtttggaaacgcgcttggaaacatcccaggatatcagtgcggaaatgtccccgccggttcccggaacgattccgactaccacaccgattatcgaaccgataaaagccggaagcgccatcctgcgatgctccgccttagtcggaagcacacgatcctttttaccgacaacggcaatatcttctttcttgctttcctttacattttcaaatatctggtacagcatctccccgatgccgaacaggcctattaaaaccgggataaaagaaattccgtcaagcagcgccacattgcctcctacaaaacgcttgcttcccagcatcggatcaaggcctatagtgctgagcaggaggccgagtgcgccgaccaccagccctttcgcaagagcgacatgggaaatgctgatcatcatggaaaggccgaaaatggcaagccagaagtactccgccgaaccgaatttcagggcaaagctggccagaggttcacaggcaatcatcagggccacggtggaaaagattcctcccatgacggaataaatcgtgttgaccccaagcgcaaacccggttctgccccgtttggatattttatatccgtcaaaggtggttgcgatggaggcaggtgtccccggcgtattgatcgcaatcgccgatatccctcctgaaaaaatggcggaattgtatacgccgagcagcatgccgaagccattgaccggatccatcttaaacgtgaggggcgtaatcagggagacagccatcaccgaggtcaggccgggcagggttcccactaccagccccatcagtacgcccattgtgatacagaacaggcagccgggagaaaatgcagtttgtattgctgataaataatccatatagtcacctcattaaccgtgattgtgatttctgtcccaaaggccatgaacaccggcattcatggccgccgcttctgtccgtcagcaaatattcaaattcactttcagcaggatcgtaaacacaaaatacagagcgcctgtcactgccgctgaatagataatagagaacagaagtttttctctgaagaccatacaaagcaggaagataaaaatgacccctgccgccagaaacggcacatatctccagaggattagaaaaagcgccaaatctgacagaaccaatatcattcttgtacagccctgctttccttccggtgtggaaagcgcgcctttaaagggcttctcagatttaaaaacggactgaaccataataatcacagaaagaatcagtattgctatacatactgcattcggaaacatcttcggtcccggatcccccatcgcagaagccgatttcagcgtggcattggaaatatacagcgtgataccggctgccgccgcaaataaaaaacctactatcgtatttcctgtaatcttcttcattttcattctcctaaaaattcggacgcttactgaccaattttaaggtccgagatcagctcggaataataggtataatccgcttccgccatggcaaggaattcgtccggcgtataataagtgctgtcacaacctctgcctttgcagaattcaatataagcgtcgccggcaaatacattcttcaacgcatccactaggatctgctgctttgcctcctcaattcccttcggggcaaggaatcctacccagcagactacattgatgtcatggccctgttccatggccgtcggtgcatcaggaagaacggagcttctctcctcgctgaaggaagcaagacatttaaaatctcccgattccacataggaatatccctcacaggtaccaaccacaacagcatcgatctctttgcccagcagcgccgtaaccgcaccggtagctccgtcatacggcacatggttaatctcgattcccgtcttatcggccaacacacaggcggcaatatgccagatcgagccgattccggagtttgccacgcgcaccttgccgggattctccgtacagtaattgataaaatcttccagcgtatcatagggagcgtcggcaggcacataaagcgccgccggccaggacatgccgcagcccagcagctggacatcctccggagccagttgtgcatagccaagcgcctctatcatggaaagctccaccggagccgtaccgatggtatagccgtccggtttggaattcatgacaaactgcattcccacagagccggaaccgcccgtcttattatctactgtgaccgtccagccgtttccatcctgcaggccctgggccacctgtcttgccagtgcatcactgcctcctccggccgccgcatgacagataatattaagcgtatccttcggaaaatccacggctgccgccggttcttccccagccggctctttctcagatgccgcctccgcttttgtctcaggagccttcgtctcagcgggctttgcagaactgcatgccgtcaatccaaccatcgctgctacacacaatacaggaaccatttttgccattctttttttcatttttcttctccttttttattttcttttatgctgtcccacgtgcggacaactgttgtttttctctgttttactgctgcttctttactgctgttttttaccgatattatttcatctgtccctacagactgcagcggtacctcacaagctgcgccaccccatgatttgcagctattatctcagcgctatctttccattcgtttacaataatctgtgccggggcctgccccttgtcaatcacagtctccgaacggacagacagcctgttttcttcttccctgtttggattaaagcggtacagggacagttgcattccgcctcccctgcttcctgttatcagtccgggttctcccagaaaactgcctccccagagcacatgcccgaaatctaacggcaattccagcgcccgctcatatccgcctgcgccttgtttgaaaataacggctttatcgccatggaatccttcaattatggcaatttcatccattccgtccccatccaaatcgtaacagacaatatcacttaccggtatgtccaaaatctgtctcgtctcccaggttccgtttttgcgtgttgtcacaaacgctccttcgcttcctccataatagagatcgtcataacccgactcatttttcctgataaacattgcatggtgtttataaatcccgtcccggacccgttcaaaggacgagacgccttcctccggttcgtaccggccgatttccatactccccgaagtggaccagtcatccgaacaatccttgtgcttacagagctttccggccgcaataaaatttccgtcttcctccgtaagctgtgcaatccggtgtacatagggaacctcagccaccgtctttcgccgtgatgcggcccagcccttcccggtccgctcaagctctgccttcacgatcttcgctccagccgagtcaaacaccgggtaaaattcttcgatacagagaattgccctctcctgcgccgctcccagcactgccatcacgcctccctggcatccctgaagctcactgatttccttcgtcatgctgtggactaaatacagcccgccgccacggttttcagaagctgccgcatagtacagttccttgtccagaagaatctcccctaccgcataaagtccggggatctgttccatcaggatctctttctccaccttcaatttctttcatccctccctgatttgtttacacgtgtaaattattaaataaaaaataaagaaaatattgattattgatccatcatggtatttacacgagtaaatatattcttaaaaacaatagcttcaggtttatcgttacgattcacggccctgccgaacagcgccgttccgtgaacaaaacacctcacgggatattacctgaacagtaacggtttatcatccgctattgccttctactaaaaatacgggaatctttttcgtcttgattccttctgcatctgcgccgtgaatcagatagtccaccacggcctttgctacgtctacctttgaaaagcctgccgtcgtcagagacgggctggcaattccagccgaagacgtattatccattccggtgatcgacactgtctccgggttataaagctttacttcctttaaatatgtcattatccggattgccagataatcattccctgtcacgaatgcaatccttccctcttccttaagactgcggcggcagatttcctccgcccttttcataatgtcctcataatactcattgtcataacagattaacgtctcttccaccgggcgtccataatgtctcattgcatcctgatagcctttaaaacggaagtcagcgctttcccagtagctgagcttagagcggtacggagggaaaaatgcaattctctcatgtcctttcagaatcagacgttccgtcagcatataagccgctttgcggtaatccacctcaatgcactttacgcgcggatccagattatcataatgatgcgccttgtatagggcaaccgggatattgctctttgctatctggttaatctgttcggtgctgtaaatactggtagccagaaatattccgtccagccggtgatccacaatgccattcaaaaatttatcatcctgatggctggtgcataaaaacaaactgtagccattctcataggcatatctctcgctgtagaatgcaatctcggcaaaaagttcacttcggatatcgtcgcaaatgagtcctagattattcgtctttttatttttcaggctccggcccatataattgggctgataattcagcttttccaccgcttttaatactgcggcccttttttcttcacttacataattcgatttgtttaatacataagagactactgcaggagatacccctgccaggtcagcaacatcttttctggtggccatattttataccttctgcacaaatatttttttatttacacgtgtttatatataaattaacacaatagtttttaaatgtcaatagtgaaaccccggaaatgtggtttccggggtatgctttcactggtggcggtaacccgtgcgcggtgcctgcaggttaccgttgttaaaatgtcattgccgcagtctgtctcggcatgtccttcgtaatttcgataacgttctgataccgcactacattctggcataatcccaggtattcgttgaccgaacccagcacatcaaagccaaagcccattccacggtaatgcatgggaatcaccacattgggagtcacgtactccaccaattgacgggcctgggccgcatcaatcgtgtaatagcctcccaccggtatcattaaaacatccaaatctttcagcatttctctctgttctttcggcagttcgcatcccaaatctcccatatgggcaattcggaatactccgtcatccagaatatgtatcgtacttttgcctctcaggtcaccctgcttttcatcatggtaagtggaaatttcctgaatccgaaacggcgacgccacattcctgtttctgagtgttactgcctcacggaagttatggtccgaatgctcatggctgcataaaacctcgtcggcttcgattctgagcggttttaatccgggaacttttccgtctgcatatggatcaaaaaccacggaatatcctccggactccaccttaaaacaggaatgtcccagccatgtaatcgtcaatttctcattcatcctatcatctcctctcatttcctgtaccggcgtttcgcggtgctgccgcggtacattactatcatacccaatttcacccatcattgcaatcatttggtaacagttcatgctgtctgaacggttacaaccgtttgataccgtattggaatttcatatgaaacttcttgacaatctgatatcaaacaaggagaatattaattgtcacaaaacacactctcgataacgcttcgggcagtattgcctgtgaacaataactaacagaggtaaaagaacgtgaatccagattcaaaagacagcttaaacaaatcaaagacagcccgcgggattttctttacgctggcgggcggtaccatgtggggtttttccggcacctgcggccagtatctttttacatataaaaacctggactccgcatgggtaacggtcacgcgcatgatttgcgccggcatcatcctgctggtcctggcctttataaagcagcgtaaagagatgaaagaaatcatgcaggataaaagggaccggcggcagcttttcattttctccatcttcggcctgatgttctgccaatacagctatatgacggctatttcccattccaatgcagggaccgccaccgttttgcagtatcttggtccggttctcatcatgatcgtgtcctgctttatggcaaaaaagcttccttcaggcagggaggtcttcgctatcatcctggctgtagcgggaacctttcttctggctacccatggcaatatccactcacttgtcatctcaaaccttggcctggcatggggacttttatcagcggtggcattgatgagctataccatgctgccggaaaaaatcataggacgctggggaagcacggtcgtcaccggttacggcatgctgataggaggtattttcctgttcttcgccaccaggtactggacggtccgtgtaacctttgatctgggaacggttcttggcctggccgccatcgtgctgattggaaccgccctctccttcaccctctatctccagggcgtcagtgatatcggctccgtcaaagccagcatgctggcgtgcatcgaaccggtttcagcaaccgttatctccgctctgtggctgggcaccgactttaccgtaatggattttgccggactggcggctattatcactacggtactgctgctgacacagagaaaaaggaggggatgagagggacagccgggctgtctcccttttccatgatatctcaggatgtgaatcaacgtcatttagttaagcaggtgaggacgccgccggtacggccagcggacggggtggtgaggtgtgtatatgagtctttcgtcccggggggagattgtcgtggtttggggctgcgggcgaagataaagtctgcggagcacactcccgctctgtgaaatgcatcgcgctgctaagctcgtaagggacctcgctaatcagcaatggatttcaatggcatccgcagactttatctttccctccgccccaaggccggggtttcgccgggacgaaagactccgccgggtgtaccggccccgtccgccggcctgcggccgctgaatgtctcacgcgttaagtgcggggacggaccttgtcgcgaccactcagtgctaccgtttacgggtgttacgatatgccttcaatgcgcctttatgaaagaattgcactagagttgatatctgcctgcgtaaacacgtagtggccgcgacagggccttcctcatttaaggttagagacaatcagcggccggaacggaccatgtccggtgccggaaaaatcttcgcctgagtcttccgtccctgcgaaatcctgaccgggggaaggaggcggaatcaattctggaggggatatggaagcccatccgtgcagaacgataacctgtacgctctgcgtacaggtcaccgccttcaatgaggtttcttacgaatttagcacggctatgcgcttcgaaaagtgcaaacggtccccgtaagaattcattccggccggattcccccctcacgacaaccttcaaccagggacggaagactcagccatccccctcaccacaccggacatagtccgttccggacgcgtcctcccaacctcagttaaatctaacctcaggccttcttctccagataatccaccgcaaactgtgcataaatgccggaaccgtggcaaagcaccgattcgtcaatgtcgaacgacggatgatggtggctgcacacgattcccttctccttgttccggaatcccaaatatccgtatacaccgggaatatgctccatataaacgctgaaatcctccgctcccgtcatcttcggcaggtgcttcaggcagccctctcccagctccttttccgccgctttccgggccagctccaccagctcctcatcgtcgttgatcagtgggcttgggccaaaatagtagtcgcagtcggcactgcagccatatccttttgcaacattcgttaccagctctttgattcgatcaggcattcccgctctgaattcccggttaaaggcgcgcaccgtacccaccagctccacgtggtctgccagaatattttccttcgttccgccgttcatcatacccacggttactaccaggctgtccagaggatcattgatccggcttggaattgactggagggccattaccacggcggcggcagccaaaatagcgtcgcgtccctgatggggagcgcttccgtgggacagtttcccgtgaatctgaattgtaaaacggtcgctgcaagccatacgttctccgctttcaaagctggccgagccgagatccatcgcggaccagacatgcataccgaaaatagcgtcaacgccttccaaagctccgcgttttacatactcttccgacttccggccgatctcctccgccatctggaaaatcaatttcacggtgcccttaagctccgccttatgttcacttaatatgcgggccgcgcccagcagcatcgccgtatggcagtcatgtccgcaggcatgcatcactccgggattgacactgcaatagctcttgcccggattttcctgtatcggcagcgcgtcgatgtctgctctgagcatcactgtttttcccggctggccgccttcgatggtgccgatacagcctgtgattccctcaaaggtctgaaccggaatccccatctcctcaagctgctccctgatataacgggtagtttccacctcatgttcccccagctccggatgggcgtggagataatggcggcatttaattacgtaatcttcctgttcctttgctaattgacggatattcatttcatctcacctcccgcgccggcttccagataatcagcggcaaactgtgcatactgtgccgctccgattggaagaatttcctcattaatcctgaatttttcattgtggagggcatggacacagccgctctcctcgtcgtagcatcccagaaatacaaacagggaggaggggattttttccataatataagaaaaatcctcacttccgcttgccttaggcgtcgtagccagcacttccctgccatacagcttaacggctgcgttcctggcaatttcgttcagcttcaaatcgctgttacacaccggaggctcaagatatttatattcgatttcagccgtacatccatgggccattgccgtataatccacaatctggtgcatggcctgctccaccattccccgcgcttccacggtatgggcccggacagtcccctccaagacggcggtgtccgtaataatgttaaattgagttcccgcccggacagttcctaccgtaaccaccagggaattcagaggatcgtttacacggcttacaattgtctgcagattagtgataatggcgctggccgccacaatagcatccttcccctgatttggtgcggagccgtgggccgaaacgccgtgaaccgtaattttataattatcgcagcttgccatcagcggaccgtccatcacgaccagcctgccgctggaagccgtaggccagacgtgaagtcccattgccgcatccacgtcgtcaagataccctttgtccacataataatggctgccgacaaacacttcctccgcagcctggaacaaaagcttcaccgttccggccagctcttctctgctctcccacaaaagcctggctgctcccaacagcatggctgcatgacagtcatggccgcaggcatgcatcacgccgggatggatactcttaaattcaacgccgctgttctcctgaatcggaagtgcgtcgatatctgcccttaaaagcaccgtcctgtttcccgggcggcctcccttgattgtggcgatacaaccggtataatcgtcaaatttctgtaccggtatgcccattttttcaagctcctccaccagataagccgtcgtctcctgctccttgaacgacagctccgcatgctggtggagataatggcggctggcagcgatttcaccgctcagctcagccgctctcttcccatagttcataaatagctcctttcctaaaaacggcggtccgattcataatcatgccggaccgccgaagtactcctatgtactgatacaattgacctttaaaatatcgctttttacggaaggtaaatagctccgccaggtccaagaggaagattcattcctacccaaatgattacctggacaatccataccactgcaaaagtaatggagaatggcagcatgttggcaataatcgttcccaatcctgccttactgtcatatttacgcgcatatcctaaaataacgggcatgtaggtaaacagaggcgacagaggatttgtgatggagtcgccgattcggtaaaccacctgtgtcaccgccggatcgtatcccatcagcatcatcatcggtatgaaaaccggagccagaatagcccattttgcagaagcagagccaatgaacaggttaacgaaacaggacagtataatcaggccaatcatcagcggaattccgctgaaaccgatattctgaaggaatccagccccattgatagccaggatggttcccagtttggatacagcgaagaaatttgtgaagatggagataaagaaacacataaacacataattgcccatctcggaaaagccctggctgatatcggcccatatatccttatcattcttgtattttccgatggtcacgccgtagacaataccaggaatcatcagagccagagtaacggaaaatacaattccttttgtaaaaggcgaattgccgcctgtaatggaacctgcctcgtctgccaaaatggcagtcggcccgaaaaccggcaatgataaaagcagcagtacaatcacataaatcaactcagccagccccgccataagaagtccttttttctggattggggtaatattggccgcgtcttcatcaaaatcgtatttagcgagctgttcttttgtcatcgggaaacggtgaaccatgaccttttccaccaggattgtacctgcaactgtcaacaccagacaggacgcaatcaggaaataccagttaattgccatggatgcggagtaattcggatcaatcatctgagccgcggactccgtaaaaccataggccagggcatcagacagccccagaagaatattggcgcagaaaccggcagccacggatgcaaatgccacataaagtcccagcagcggactgcgtccgatggacataaacagaatggcagccagaggcggcaggatgataaatccggcgtcacccgcaatattcagattgattcccaggaaaataactaccatggaaactatccatcccttggcgcctcccaggaaatgctccattaaagccacaaggaaaccgctcttctccgccacggacgaaccaatcacggctaccagtaccatacccagcggtgcaaagcctgagaaattggtaattacgttcgtccacaggtactggatacctgccacggaaaaaagattaaaggtttccacggtggaaccgtctgccggattgacggcagtcactcccagcatactgcaaattgcggaaataattactactacaactgccagtcccagaaacagagtgatcggatccggaagcttgttgccaacccgttcgattgaatcgaggatccgatcaagcattcccactttctctttttttgtcttttcttttgtcatacttctcctttccccaaccgcgttaactgcccggccgaaagcagtcccggcagttaactgtacgtccctctgccgaaaaataacatattaattatatcaaatgaaaaggtatgtgacaacaaaaaaatcaggcctgcaaccctataatttcagaaaattagttgctatttacattcattacaggcaattggcggccgttatctccggcgccggaacacggccgctttagcgggccaaactttcttaacgcacagtgcgcattctccgaaaagcggtttttattaacaaagcggtttttatttaacaaagcactttcctgttaaataaaaatctcagcttccgctctgcgggtataattctgctccagcatagcaatatgggacagaaaagccggatcatcaaaatatttggcattggtcggacattttttcacacatgcctggcatttaatgcagattcccggaacttctttcggatcctccctgctgatagaacccatcggacatgcctccacgcagataccgcagctatcgcagtcctccggccttgtctttggttttgcctttaagaataccgccggctttccatcggtgccaagaggtgtgtagtacggacctaccggatcctccccgcgaacttcgattggagcgggaatttcctccatcttttccactttctcagccactgcttcggcaaaccgcatcataatctccctgtctgcttcatccggccgtcccggagcaatcttatcggaaaatacatggcttacggcaaatccggctcctgcaatcgtgtggaatccattattctcaagctcattgcgaagttcaatcaatccgttgtcaaaatttctgttcccgaaggtgactaccggtactgcaagcgcgccttcccccttgaagttgttttgaactaccggaagcattttattcggcacacggcctgcataaacaggtgtgccaaacaccaccagctcagacggagcatacgtctgcacctcagttctgccgcccggcagcgtaaaattgcatatttccatcgatacccccagtttttctgcaattttttccgcaatcgcggtaacaacttcctcggtattgcctgttgcgctgtaaaatacagctttaactcctgtaattttcattcgtttgcatcctccctattctatttttccagttttttactgtgtttaaatttcattatagcagttatggggggattcttcaaatggagatttaactgaggtttggaggacgcgtccggaacggaccatgtccggtgtggtgggggagtctgtctgagtcttccgtccccggttagagggtgtcgtgaggggggaatccggccggaatgaattgctgcggggagcgtttgcactctttggagtgcgcatcagtgctaagctcgtgagggacctcgccaagcaccggcggactcccatgtcccctgcgcaattgattccgcctacttccccaggtcaggttatcgtcggggacggaagactcaggcggagattttcgcggcaccggacatggtccgttccgggcgctgattgtctccaaccttaaatggagagggccctgtcgcggccacttcgtatttcccgcacacggaagcgctgagtggccgcgacaaggtccgcccccgccagaccgtccgaaaacacgttttttattttattttattagatttttatgttttacattgaaaagggtcctggtcctttcctatcatttttaataaaacaccttcgttttatgtcatggcttccattaatctggcaaatcccaacagattctttgctctctccaggttatatcccagacacatgagcgcagtttcaccggctaccttctgcttccctcggagcagatagtagcctgcgtccatccatctctttatcgttccaaatggatgctctgacagattttttcgctggctcatttttttcctgtccggacgaaatgttatcctcaccacttttttaagctcataatggccggtttttacctgcttctctttctccgcatccttcccatctgatttcagccaatcctgacagggcttttcacgtgtatctttgctaaaatcgatttctttcccctcgtttttccctttataacacccgttccgtttcttacagtgcttacaggcactcttgtttgcataccggatggtcccgtttctcttgacacatttctgcctcaggatttctcccgccggacagtatacaagatttctcttccggtctctcacaaaatagccttcctgtgcatgctttttcatttcttccccgttgtcatagagggcgccggctggttcaatgcccgcttcttttacaaacacctttttttctactatggctgccttttctatgattccttcgtattctttcgggatgttccctgaccgcaggcttctctttatcccttccgctccggcctccgtatccggctcttccccggcctcttcataccggatctccagctcataggtatcctgaccggacggaaggattacatttggtataatccctttttccaggcagtccgccatatcgtttacttcatggtatcctttatctgccactgcctccacgacggctccggctgccgcttcttttattgcgcataccgttgctccaagcagtccatggtctgtgatctgattggttacaatataatcttcgattaaatgtgtttcggaatcgaccgcggtctggacattgtaagctacctgaaaaccgtttttacttttcataagccttgcatccggatcggtcagagagagctgggataagccgttttcttccatataagcacggtaccgctggtaatattccaggcggttgtgagcctccttcagtcttttctccagttcctcccgggtcagttggcccgacggctcttcctggtcttctttttcatccagttcggcaagctggcgcagatattcatccgtgtgctggttcaaccagcgaatccggtcatccaacttattggcggtaaagttattatccttggaattcactgcctgaaatttacttccatccacggacacaaatcccttttccagaaattttgaaatccgcctgttaaactcatgaaatatttttttcatgcagtcgatgttttctttacggaaatcggaaatggttctgaaatccggctccaatccctccatcagccatttcacctctacattaagcctgcatgcctcggccaggttccgggaggatcggattttcttccggctcccataaagatacagctttatcatgcatcgccagggataggacggcctcccctcaatagcggcttttctttttgcaattcctattttttggggttccagcccttcaacaaaagcatcaatcactcttgcgatactctcaggtgctacaaaagaatccagcgaacacatcatcaactgctcccgatctaccgtacgaatataaggcatttgatcaccatcctatatatttttatacgtattatactatgaacagagcggaaagtctttataaatgcatgctttatacaattatcaataggttgaatttttcgaagcggatgctgcgcagccagcttcaaatgcgtctaatcactcctggttttcagacagtctcccgcacttaacgcgtgagacaatcagcggccgcaggccggcggacggggccgatacccccggcggagtctttcgtcccggcgaaaacctggccttggggcggaggggaagataacgtctgcggatgccgcctaaatccatcgctgattagcgaggtcctttcgagcttagcagcgcgatgcatttcacagagcgggagtgtgctccgcagacgttatcttcgcccgcagccccaaaccacgacaatctcccccgggacgaaagactcatatacacaccccaccaccccgtccgctggccgttccggcggcgtcctcacctgcttaactaaatctctttaactgaaaaattacaaaaaaatatttaatttacaaaaatcattgatcaacccacatttctatgctataatccgttttaaagaactcttctttaagtatgctgcaaataaaagcatacaaaattactatcaaacctacctcctgatgcggaaatgattgtggggggactcagaaaggatggtgttatgacagattacgaactgtcgtcagtaaaaaaagttattggaacacattttaagaaagctgctgaactgagctgttacctgagagagcatccggaacttccggatcaggaatttgaatccagcagaaagatggtggagatcctgaaggaagccgggttcgaggttatataccccttcgccggatatgaaacggcattccatgccctcttcgacaacggtgacggcccggaagtggcaattctggcggaatacgatgcacttccggaaatcggacatggctgcggccacaatcttcacggctctctttccgtactgacaggtctggcgcttaaagatctaaaggagttttacaggggaaaagtgcatgtgattgggacgcctgcagaggaagaaaacggcgctaagataggcatggctgcccagggcatctttgacaacatgtctctggccatgatgatgcacagctggtcggggggcaagtgccgggccgatatggacgcgctgagcctgcaatgctattttgtagaattttacggacaggcggctcatgcggttgccgcaccgtgggagggcaaaagcgctctggcggcggccaggaagtttctggatttgattgatgcgcggcgcgaatgctttactccggatgtccatgtaaacagtatcatcctggacggaggaaaagcgcccaatatcataccggactatgtaaaactcaggatggaattcagaaccgcaacgatgaaatccatgggagcagtggatgaaatggtgaaaaaatgtgcggacggcgctgccatggctctggattgtaccgtgaaattcacctctgtttttgaatttgcagatatggtacgcaacatgacacttgaggaggagatcatacggcagtttgaggcattcggcatgccgacaacgggggttgaagctgccagcggttcctctgatgtgggcaacgtcagctaccggtgccctgccatccagcctctgttagctgtcacagatgaggattatgcgctgcacacggcggcattcagggatgcaactgccctacctcaggcagaggaggcaatggagaagggagcctgtatcctggcgctgacggctcttaggacatttaacgatgaggccttcagaaacaaggtgtatgcggaatttcaggaacaggtagaaaaaagaaagtaaatggggtttttttatgagaggagaaaacgtatgagcagtgagtctgcagcaaaaacgaaaaaaacaaaaaaaatgaagatgccgcacatttatgtgcttcttatttcgattacaattatttgtgccgccgcatcctggtttcttccggccggtgaatttgaacgggcgcttagcgatgccggaagggaaatggtggttcccggtacatatcatgtaattgaatccacaccggtaggcttcttcacccttgtccagtctatttataacggcaccgtggacgcagccggagtaatcttcttcgtatttatttcctatgcatccattggcctgatcattgccagcggcgcttttaacggcctcgtcgccagcatgctcaggatattaaagggatccgcacgtgtcattattatccctgtatttatcaccctgattggatgcgccagctcaaccatcggcgtatttgaggaaatgttcccgtttattccgatttttgtgggaattgccattgccatgggctatgatgccattgtcggccttgccattgtcgctcttggcaccggcctcggctacagcggcgccgtcatgaacccgtttacggtcggcatggcgcagagtattgccgatgtcccgcagatgtcgggcgccggttaccggattatctgtcatatcatcctgattgcggtcgcctccttcttcgttatccggtacgcattaaaaatccaggccgatccgacaaaaagccttgtttacggtgatgatttcagcagccttgccatggattcggatcatatcgaaaacaagccgtttgggatcagggaaaaactggtgttagccactctcgttgccggtatcgttgtgatcgtgtggggaacgaaagccaagggatggtattttgcggaactgagcgcagtattccttttgatgggacttgtaagcggtttcatcatgggctggggacccaatgaaatagccgagaaagtggcgaagagcttctccgagattgccgttgcctgtatgatgataggtattgcccgcggcattctggtggttctccaggcaggccatattatcgatactatcgtatactacctgtctatcccgctttcccagcttccgggagccatctccgctgttgcgatgttcctggttcagaccggaattaatttcttcatcccgtccggttccggccaggcggtgacaagtatgccgattatggcccctctggcagacctgattggcatctccagacagtcggccgtactggcattccagtttggcgacggcctttccaatatcatctggcctacatcgatgacgccaatcatctgcggtatcgccggtgtcaagattgagaaatggtggaaatggtttgtccctgtctttatcgtactcgttcttacgcagagcatactgatggctgtctccgtcgttatctggtaacgataacctgctcgcagagcgcacaggtcaccgacttcaacgataacctgctcgcagaatgtacaggtcaccggctttcaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcactgcagaaaggcagtaccggacagttgaaattcaactgcccggtgctgccttttttgtccggctttttccggaccttctactgcgttttcaatttgagatccacatgataaatattaatgggtcttcctttatttccatttctcttctgtccgcagacggatgcatatccgcccttctccagattggataaaaatttattggcgctgcggagggaaatccccagtccgtctatcaaatcctgggaagtgatttccttactctcaaccgcgttcaggacttccgcaatccgtaccaccgtctcggacgacagcttcaccttatccgctatctctgagacagaccccgccctgacggaaaaaaccggtccgatccctgaatccacatcggctgtcaggaaaatcagggattcattctggtcaagaagaaagcttccgatattgtcctttcccctgctccggccgaaatggctggcattaatggcattcagcctggcctgataaatattgtccccgattccatagcccacggaacccggaaaatccagttccctgattaagaacggtaagagctggcattgatggaacccctctgtcagctgctccatcgtctcgcagtccatatacagctccagctcatcgtaatttgccttgaaaatagccttattaaaatgaatctggttaaactgtattaccatgcgcaccagttcgagacggaacaggtcatatttgtctttatacagatccctggctttttccgtattgacatggatgactgcggaacggctcttattaaatttcttgatgtatatactctttttcagttcttctatgctattccagaacgcccactcgccgcggtacacgtaataacagggaatatctttatccttcatccgctctatgacactttgataataggtaatgatgagatccagtttcccctcctcatactgtttcacatagaagtcctggacacgctgctcttccttctcaatctcttccagactctgcatactgctccagtacgcctcatgtttataagcggcctgagcaaatttttcctccctaatcagctctttcagcgtcttttggtcatcaaggaaatccatccccacgcgggaaagatccacattctccacaccttccgtaacaatgtggcggagaagcgcctggtaagcattttccacatttacggaggcatggcctattatcgcgtcttcacttttttcacctaatattttaatggcctggaaagggataaggccgcttacaaaaaatccgtcatattgatcttttatagagagaaaaatatcctgtacctctctcaccgtcgaatatgggataaaatcaatgacaacatcttccggtttgtttgacatatagctgctgattctctcccgaaagtgttcttttagcagcagtgcaattttaaataccatttttgtccctttcagaatttgtgatgcaattattatacgccagccggcaaaaaatgtaaatacattgacattgggtgtggacagtaaccgtaacagttcagccatgatgtattccgcgaggtgttttcgctgtttttgcgaaaatcccgagttgtgcggcgcgaaacggcgtttttttgccgtttctgtgcatcatttgttacggtttagccgaaggctgaactgttaccagtaaccctatccagcctggtatggcagattgattgtgaataccgccccctgtccattctggttctctgccgaaatctcccctccgtgcatttttacaatcgcctttgtaatggccaatccgattcccatgcctcctgtctttttgctgcgggatttgtcaacccggtaaaaccgctcaaacagatgtgaaatatcctcctcaggtataccaggaccgtcgtcccggacctttatctccacgtgtccttcccgcattctgtattctactgcaatatgaccgcctccgggcgtataagccagagcattggagatcagatttatcatacactgcttcagacggtaataatccgcataaacgggcgtcttaggcggcattgccattagaagccttatatttttctcctttgccttgatttcaaagccgtcaaatacctccatgcataactccctgaaatcaaatctccgtttatctggcgcctgctccttattttcaagcagatagagttcctggagctgctccacaatcccgaccagcctcagaatttccgcgtgacagctttccagcctggctgtcgttgtctcccaaaccccgtctatcattgcctccatatgggtctgcagattcgtaagcggcgtacgaagttcgtgggccacatccgacgtaatccggcgcttttgcttttcattttcttccagcttaagcgacatttcgttgatcgcttcaatcagaagggccgtctctgcaatggaggattttttttccgcctgtgtcccgtactcaccgccggctatcctctgtgccgtccgtatcacgcctgtaaccggatcggtgacagcccgtgcgattaacataccaagaacagccacaatgcaaagagctgccgcaccgataatcaaaagtgatttatcgaggcttttcatcagctctaattcgccgtcactcagagaatacggaccgtaataccctaattttaacgtgcctgtgacctttccgtcctgaatcaacggatactgctcttccgtgtacccgcctttgaaattaggatatttctggttcatattctcttccgcatgctgcagcaccatcgaacactcttctgccctgtggctccttatatcccagtccagagttttgtcttcgttctcaagctgcataattatcccgttttgtaatgcggcatacccaaccatttcaatgcctctctgatcatagcttcctgtctgctcatcatagagcatgccgacctgagccacaatccggctgatttggtttttccgctgcttttttgcatattgttcaaatgtcctggtttccgtgacattgaatagaacgctcaatgtcaggaccagcagcactgcaatcaaagaatacggaataatcaaggtgctttttaatgtttttttcattcggtaacccctacaaatctatacccaatcccgtgtaccgtgacgataaaaacgggatttttccgatcctcctcaattttagagcggatactttttatataggtgtcaatacttctgtcatatccgtcaaaattatcatccaaagcataggtgatgagctgttctctggtaaatgtccggttcggagccttagccattgtagccagaattttgtactccgtcggtgtcaggccggcatcctgtcccccggccttaacgtctccgttttgaaaatctatcacaaggctcccctgattataggaaaccgggacgctgataagtttatcgctctccacccttctcaagactgcttctgcctttgccaccacggttctcgggctgaacggtttaaaaatataatcgtccgcgccaagcctgagtccctttatcaaatcattttcctctgtcttcgccgtcagcataataatcggtacacgggaaacagcgcgcaccatcctgcatatttcctcccccatgatatccggaagcattaaatccaaaagtatcaaagagatatcgttatttctgaacagctccatagctgccgcgccgtcataggcacacaggacctcatatcccgctttttccagataagcctgcaaaacctccactatcttctcttcatcatctaccagaagaatcgtcctgttttttcccataactgatcaccatgtcctgttttttcattttcattaacctgccaagccgggcagacgctttattctatcacagtccgggcctgccgaaaactgcagctctctttaaattactcttcttatagaaagaatacgcttataggttgccggagaaattttgattccttccctctcgttacttgcatgtactaactgattctgacctatgtaaatgcctatatgtcctttataagatataatatctcccggcaccgcattttccaaacctcccacttcagttcccgcccggccctgctccctggatgttcttggaagctctataccaaactgcttgaaaacgctcatgacaaacccggaacagtcggcgcctcccgtcaggctggttccgccatacttgtatggatttccgacaaattgggtggcaaatgcgacaacctctgctcccttatccactttttccgtctcctgggctgctgcctgtggcggaagctgttcctgcatctgtgactgctcctgtatgatttctttcccaggccccgacgcatctcttatctcctcctccgccgctttcccattcttctgtgtttcctccttctgcggtcctatctcctgcaatcccatctcctgcggtcctatcttctgcagttctatcttctgcagttctatcttctgcagttctatcttctgcagttctatcttcccagtttctttctcctgcgtttctgtcttctgtatttcatctgaccttgatttctcatacaccgcagcccttgccgcagaattctttgcctgggcaggatgactgttgactgatgtcagaaccattccaatcattaaagccgccattaatttgcctgtccgcatcttttttcctcctgtgtttcaaatctaaatattacatttctgttacaaattatcatataaatgtggggattatatgaagattatgtgaacacatgaggatttcattgtccggttactatatttattacattttaaaccaatttctatacatctgcagccagcatgctttcctatgaaaaaaggttctatactgaatgttggggtgtgctgaaaagcacacttccaacattcttttcgttgtaataaaatacatctataagaagcctcctaaacgcattatcccgaccaaagtttaatgttacggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgctccttcgcaaacgccgttacctctgcccatactgccgcaaacggttcacggaaccctattcgttcctccccagctaccaccgcaggacccgcaggctggcattttacattgtctccctgctccggcagaccttttccttaaaacagatcgcagagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccagagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcaattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggatctgcgtctggcacaccgcatgaaagagtggttctatgatatctgccagatggaagcgtatcgtcagcagcagagggaatttgatgactggattgcgaatgcgcagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagcctgaaaaaaaggactgcaactcaagttaaacttgaatcgcagcactctgctctgccttatttcataacgaatccttaaacgcgcggaaccccagcccaagtacctccgatgtctccgtaaccatgacaaatgcatcgggatcttcttcatatacaattcttttcagcttgacaaactgagactttctcaccgtacataaaagaacgctggtatccttcctgctgtatgccccttttgccggaagcaccgtcgccgtccggtccagctcataaatcaccttggcagctatgccgtccggattcccggtcacaatcgttgccatacttcccgcatcaccgccgtaaataatggaatcgatcactttcgtctgtgcatacagcgcaatcagtccaaaaagagctgcttcaatattgccgaatacaaatattgaaaacattaatatcacgctgtccaccaccagcaaggctcttccaatggacatatgaggcctcttcttctggagcaggtaaccgattatatccgtcccacccgtggtcgtccccgtcataaaaatcatggccatgcccacaccgaccagtactcccccgtacaggctgcaaagcatcctgtccccattatacaccgggcagatgggagccaccgccagatccagaatcagagagcatacgatgctcgctgctgccgttgtgacggcgaaacggcggctgagataaaaccaggccagtattaaaagtggtatatttaataccagagtcaaagctcccaccggcagatccgtcagataattgaccatcagcgcgatgccggacgcaccgcccggcgctatgttggccggaaccataaatgcatgcgtgccgatactgtaaatcacagccccaatcagaagcagccccacgtcttttaccgaaatcctttcacgaagttttaccattcctattccccttcctttcataccttccctgctgacattttccccaaaaatgctgtttaatatgattcttatccacaaatctgccgatacaaataaacaggtgacaccctctgaaggacatcacctgttattatcaggcccaaaggccatctttccattgcaggatataccatgccaaaaatcaacggtatttattcgatactgtaattcggagcttcctttgtaatatggatatcgtgaggatggctctctttcagggaggcagcggaaatcttgataaagcttcccgtctcctgaagcgtcctgatatcggccgctccgcagtagcccatgcctgagcgaaggccgcccagaagctggaataccgtatcttccaccatgcccttatatgccacacgtccttcgacgccttccggaaccagctttttcgcatcgctctggaagtatcggtccttgcttccgttctccatggccgcaatagaccccataccgcggtatactttatattttcttccctggtataactcaaatgtgcccggactctcgtcgcagcctgcaaacatggagcccatcatacatacgcttccgccggccgcgattgctttcgtcacatcgcccgaatacttgatgccgccgtctgcaataatcggtatatcatattcttttgccacctcatagcagtccatcacggccgtgatctgcggtacgccgataccggcaaccacacgggtggtacagatggaaccaggtccgataccgactttgacggcatccacaccggcttcaatcagcgctcttgtggcagcgcctgtcgcaacgttgcccgcaataacctgaacgtccgggtaagcttccttgatcatccttacacagcgaagtacgttctccgagtggccgtgtgcagaatccagcacaaccacatccacctttgccttgaccagtgcatccacgcgctccagcacattggcggtaatgcccacgcctgcgccgcagagaagcctgccctgttcatcctttgctgaaaacggatatttaatctgtttctcaatatctttaatagtgataagtccctttaagttgaagtcgtcatccacgataggaagcttctccactctggcctttgccaggattttcttcgcctcagtcagggtgattccctcttttgccgtcaccagattcctggaggtcatgcactctttaatctttctggagaaatcctcctcgaacttgaggtcgcggttcgtgatgatgccaaccagctttcttccctctgtgatcggcacaccggaaatgcggaatttgcccatcagctcgtcggcatcctttaatgtatgttccggggatagataaaatgggtctgtgatgacaccgttctctgaacgcttaaccttatcgacttcctctgcctgctcttcaatagacatattcttgtgaataatgccgataccgccctgtcttgccatggctatcgccattctgtgctcggtaacggtatccatcccggcgctcatcaaagggatattcagcttaatttttttcgtcagatgcgtgcttaaatcaacctgattcggaatgatttctgaatatgacggtacgagcagtacatcatcaaatgtaatgccatcgccaataatcttacccattaattcttcctcactttcgtattatgattgtttcaatccacacccggtaatttcacagagtgcggccacatcttatacagatgcgtggtttgacctcatgccttcttttgttaaataaactctcttattcctgaattttgagttattagtatctaatactatcaaatttggcgagtgatgtcaaccacacacgttgacgtttttccgggaaccgtatcatcgaattgtgacagctcagacagcatgaactgttacatctaattttcaaacatttttcttggagccatctgcttaatgcagcgcagcattttatcatccggttcaaaaagaaccttttcacccgcaccgctctttgtatagataaaggcataccggaccgctcccgcgtctcccgatgtataatcgcttacttttttcacctgattatcgtactccctgattctgccggaattttcaggtgcgataacctgaatatcctccagcgtgtattcggccgccttttttctacgcatcttatttaaaatacggtctacggaaaaaatcttatccaccagcagatactcatactccacattcaggttttgaattgtgtgataagcaaaagcgcacattgccgcaaaagcaataaatcctgccagaccaaacaagagaatggaaccggctgtaataagtagtcccactgccaataatatctttattaacggcgccggccccggcggtttctttttaatcaggcattctgcatagctttcattgagcatgtaatttctcccttcattcctgtctgtatctgtcgttattactatcctacaacaaattttaccgggatgcaaggtatgagaacatggagatttagataactgaaatgaaaaagtaaattccactccccatttgtctggtggagtttacttctgcacagttgatatttactctttcatacatacatgctatctttatatctccttctgacagcagtagaaggagatgatttttatgagtaaatttattcctggtaaccagaagcatctcacacttgaggatcgtatttttattgagaactctttaaatcagcggcgttctttcaaggacatcgctaaatatctctgcaaggatccaactaccatttccaaagaagtgaaattgcgtagagcctccgactggtatcacaagggctccttctataatgcaaagaacttttgtgtacgaagatacaactgtcgcaaagtgaacgtctgcaataagatccttgtttgtggcatcaaatgtacttcctgccctacctgcaaccagacctgccccgattttcaaaaggaacattgctcccggctggacaaggctccctatgtctgcaatggttgtgacaagaagatttctcactgcacgattgctcacaagtatacctacaatgcgcactttgctgatcgtaagtaccaccagattctcaaggactccagaagcggcataagcattacaaagcacgaattacatcaaaaagataggatcatctccccattgattgaacagggacagtctccctatcagattgccgtaaaccatccggagctgggcatgtctgtacgcaccatttacacctacatcgataagggactattctcttccagaaacattgatttaaagcgaaaacccaagttcaaaccacgtagatgccacaagacccagattacggatcgttctgtatttacaggcagaacctatctcgattttcaagggttaggacttaattcatttgcagaaatggatacagtccactcctcacgagagtccagaaaaacgttgttaacgttctattttaccaaagagaaactatttcttgcctttctgatgaaccgctgtacaaaaggcgctgtacggcttgtctttgaccacctggagaagcgtcttggcacttataagtttctttccctatttgaatatacgttaactgaccgtggctctgaatttggggacccggacgcattagagaccggaatcaacgggttccaacgctgcagcctatactactgcgatcccatgcgcagtggccagaaaggtggtgttgaaaatgttcacactatgctgcgtatggtgcttcctaaaggaaccagttttgaattcctgacacagtgggatgtgaatcggattgtggaccatatcaattccacgccccgtgaaagtctgaatggcaaaacaccatacgaattggctttggaatcctttggcgaagatactttaaaagcacttcagcttaggcgcattgcccccgacgaggtcaatctgacacctaagctgatccgctataaccgttaactaacttacaaaaatctgctgtcggactggaagtaaacttttcacattttttgaatgtggctggtggaatttagtcttgcacacaaaactccagtggcctgttttctctgtcctaaaatatgatttttcgtaagaagttagcctaattatagcagaaacattagaaatatgcttaaaaatatctactatttatactgatttttaaatggtgatggaattcacctttgcactggaatttactttttcaagtcagcggagatttagataagcaggtgaggacgccggcctgcggccgctgattgtctcacgcgttaagtgcggggacggaccaggtccggtgcgcgaaaaccttcgccagagtcttccttccccggcgaaaacctgacccgggggaaggaggcggaatcaattctgcaggggatatggaagcccatccgtgcttaatgaggtttctcacgaatttagcacggctatgcgcttcgataagtgcaaacggtccccgtaagaattcattccggccggattcccacctcacgacaacctcccacgggaacggaagactcagacatccccctcgccacaccggacctggtccgttccggacgcgtcctccaaacctccgttaaatcatcccctcgcctttctcctctccgaagtcacattgataatcataacaaggatcaaaaccagtccccatatcagattcttataataatccgatatgttctggaacatggaaaatcctgatgacagagtctggagaatgacgacggcgattaccatccctgccgccttcccttttcctccgttggggctgacgcctgcgaggacacagatcaggatcgccggagtcaggtatgattttccaaagtcggagcgggccgaattaaagtgtccgcacatcaggagtcctgagacggatgacagcatgccgcttatcatataggtaagagtgattgtctttttatcatctattcccgaatatctggttgctgttttgttggaaccaatcatataaatcttaaacccgagtgacgttttattcagaataaatgccacggcgccggcacagacagcaaatatgatggtcgatgccggtatggcgtcaaagagacggtagctgacgacaccgttcaggataggcggaagctcttttacggaagaaccattcgtgattcccacggctagtcccagaatgatatcggaggcgcccagcgtggcaaccattgccggtattccgattctggagatgagcgtgcccgaaaaagctccgcaaagtcctccgattaccaggccgacagcaacaaccagcagcagtacaaggatctgcaccggcagtgacgcgtcgttcggcataaccgccttgagcatcatacagcacaggattcccgacagatcggcaaccgccacaacggtcaggtcgattccgccgcttatcattgccagcatcatcccaagggagagcacgcccatttcagggaaaagataggctatcagcttcatctgcccggctgagaaaaactttccgcccgttgccacggtcagtacggcaaaggatacggcgaacatcccgagcagcttcaggttatttgcatttttttcgcggaattctttattcattccggctttattcttatcggctttatttatatcgcccttatttatatcgcctttattcataccgcccttactcattcgtatccgccccctctcccttatttccttccagaatattggaagtcaccttccgctcggcggctaccatcttataagccgatgcactgaccccggcaatgataaggactccggtcatcagtttactccagttagtcggaataccaagaagaatcagattgttggaaatcagcttcatcagcaggacgcccagaaatgtaccgaatacgctccctgaacctccggcaatgctggctcctcccaggacaacggccgcgataatcgtcatctcataaccgtcaaaaaatcctatctggcacatcccagacagagttacctgggtcaggccggtgatgcctccgataaatcccatgaatgtaaagacaaatatccggattgccgctaccgggaaaccggcccgctcagcggcgacctgatcgccgcccacagcgtaaatccccctgccgagcatcgtatatttcataataaaaccgaccagaagaaggactgctatcaggataaagatactgaccggcatggaacttccaaggcctgtggatgcgcttctgactgaaaaaaggctggaggacgccatttgggaaagaggcgccggtattgcggaaataacgctgcttttcagtaccccctgagtaaatcccagatagatggagcaggttcccagcgtaataatcagagtcggaagcttgagccacgccgccaggacaccgttgatcaggcctaggaaggcgccgagcaggcccgctgcgagaaagccgacaatcaccggaccgtcatagcccgttgtctgaaaccattttgtgactgcaaacatacacagcattgccgtatagggaaacgatacatctatgttcccggaggcgataaccataaaaagtcccgctgccatcattccgggtacaatcaggctcctcaccagatccacgatattattcgccgtaaaaaactggccgctcttcatctggatgagcagagacaggacgacgataatcagaattacataaaattcattccttttcagcagtttcttcatattcataccgctttcatctcctctccgcctgtgattagcgcctgcagcttcctgctgtctaactccgtattcctgtgccggctgataatccggccgttcttaataatcagtatccggttgcagttcatcagaatttcgctgatgtcgtcggagatcaggacgatcgccatatttttctttgccgcaagccctcttagataattgtggatatcatatttggcgccgatatcaacacccaccgtagggccgttcagaatcagaaccttcggctccgtctccagccatttgcccagcaccaccttctgctggtttcctcccgagagcgtctgtatcccgtccttcaaatcgttcagttttatccccagatttctgacccagtccttcgaatcaacatgtccccgctcaaaatccacagtcctgtttttctttctgagccggtctatattggatactatcatattattttcgatggactgcgtcaggaaaagaccttccgtcaggcggtcttccggcacataggctatcttcaggcggagcgcatccatcggggactttatcaaaacttccctgtcctccacaaagattttcccgctgtccgccctgtaaaggccgaataaagccttcgcaagctccgtcctgccggaacccaagaggcccgtgattccaagaatctcccccggatggatatcaaagctgatattttcgaatccgttcttcagacagagattttccacccggaacaggctgcggttatagtccacatccttaggatcgaaataatcctgttctatttttcttcccgtcatataataaataaactggtcattatcgatattcctggcagaatcggaaacaatatgcctgccgtttctaaatacggtaaactgatccgcaatctcaaacacttcgtccagcttgtggctgacgaacaggaccgagatcccctccccctgtagctgtctgatgaccctaaacagcttatcaacctccttgcgcgtgagagcggaggtcggttcatccatgatgataagcctggaattatgaagaattgatctggctattgcgatcagctgcttatcggcaatggacagggagccgaccgtggcatccaggggaatatcgattccgatatgccgaagcgatttcctggccacctcgtatacgttcttccagtttacaattttcttcctattataaagctcataattcaaagcaatattttcagccgccgtcagattgggaaaaatagacatatcctgatagatgacctggattccaagctggatagactggttgatgcccagatttttatacgcctttccgtcataaataatctctcctccgtccggtttataaaatcctgaaatcaccttaatcagcgtggattttccacagccgttttccccgaccagacaatggatttccccttttttgatagacaaattcactttatcgagagctttcactccgccaaaatgctttgatatctctttaacttccaataatgtttcgttcattctgccacctgcccctgttttattccgataccgttcacagcactgaaaagtcttgcagttacaacggtgttttatacctttcacctctatcaataatgcttgcgtatccgtctgttttggatacgcaagcataaattctgaagatatcatagagtgccgaatagagagtctgcgccggagcgcggctgctttagaactgataatctcccatattgtctttattgattgtaaggattgcgctgccgcttatgttggtgccgttaaccttaatgctttcatacccttcaattccaagattataacctatggctatcttgtccttctccccgttcagaaccattacggccagttcgcacattgcttccccggataaagcaggatcccagcaaagtacgcacgggttggaaccggattccagataagggccggatacggacggaactccggtgcctacggcaaatatctttcctgtcatccccagttcgtcgattgctttggcagctcccggcgggtcatagctggatgcgccgataaagcccttgatatccggatatttcttaataatctccttcgccttgttgtatgccatatccatattatcttcgcattcaatccgctcctccggaatcagctccatattcggataattggctttctgatgagctaccgcagcgtccatccactggttgtgggatgtggatgagaggaaagcgaccattgtgacatactgtccttcttcgcccattgcctttgccagctcatccatcatggcctcgccgtactcagtattgttaaacgcttccagatcatagtcgcacgcatcaaagccttccgcttcatgggtaattaccacaatccccttttcccgcgccttggcaagggccggtttgcacgcctccggatcgatcggaaccacacagatggcgtcaatatcctgttctatcaatgtttcgattacctggatctgctcagcggaatccgtctttgacgggccttttacataacagttgtggcctgtcgtctttgcgtattcgtcaacgccttcctgatggcgcagacaccacggatccgacatatccttcacaacggtggcaattgtatatgttttcccttccgctgcctctgcattttctccccctgcttccgactggccctcttttacttcccctgccgcctcctgagccgcctttgtctccggtgcctgtgaactgctgcacccggccagggaagctgcggtcagggaaataaccatcactgccgataataaccttctcttcatatagttcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccgcttcgaattaccgaaaatcctatatcggaatggaaaagaccgatcccacggatgcatatctcatcgcggacttcggcagggtaggccgcacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttgtatttaaacattccggctctttccgatgttcctcagtcctttcataaaggaatcatcacggccgaaaacatcatgtaatttcccataataacaatacaattcatcgtacagcctgcctcttgcgccatcaggacggtagacaagcgtctcccccgggatcagacgctctgacgactcttcaaaatccatgcagcccggatatccgcattcctttcccacagcgacggccgcacaggctgcggcgcctctggcgggcacattatctatctgaggcactataacctcctgatggaatatgtccgcgcacatctgcataatccacggactcttccgcgcaatccccccgaccgcatagatcgcatcaatcgcaacgccgttattcttataattctcaagaattttcctggaaccgaatatatttgcctccacaagcgcccggtaaatttcttcagtttttgtatgtagcgtaagtcctattatcgctcccgacagattgtagttggacagtacgctcctgttcccgttaaaccagtccagagcaatgagaccgctttcccccggttccagatctgcagccagatcccccagatactccaggatgctctttccttcctccccggctttttcataatattcccggggaaccgcattccccgcaaaccattcaaacagatctcccgttgcgggctgccccgactcgtaaccatacagccccggaaccatgccgtccgccgccaccgagcacacgccgtcaaatgaatgaaagtcccggcacatcatctgatggcaggtagaagtccccatcaccagcatcatgcttccgcttcgggtgactccggctccgcagcccgccacggctccgtcactgtgcccggcagataccgccgtatgttccgtaaggcccagccgttctgccgccctgctgctcagatggccggcaagatctccgacatcgataatctcacctgcgaactttgtctcaaccaagtcttccatcatgggatcaagggcctttaaaaagctcctgtcgggatatcctctgcccttaatccagaatgcattcaccccgagaatgcctcctgtcctctttaaatttcctgtcagccaatagacaatccagtccaccgcctccataaacaaatcggttgcccggtatatttcagggtcctcttttgccacctgcataatctttggaaacatccattcggatgaaacggaatttccaaagtattccctgagccagtccgtgtgttcccttgcgtaccgttctatctcctcggcatatttctgggccccgtgatgcttccacagcttcggccatgcattggggatgtcacgaaattccgccttcctgcacaggggcgcgccgtcctgacagaccggaatcatggtgcagcttgtaaaatcagttccgatacctgccacatcctccggcggtatccctgattcacgaagcatctgttctgtcacggaacacatgctgtttaaccagtcgtccggatcctgcaggaaccattcatcctcaagcgggatcggtttgtggtgcatcatgccggaaattactccgtttttatatctgctctctgccgtagccatcagctttccgtcttccagcctgagagctacgccgcggcatgagagtgttccaaaatcatatccaaagacgtatttacccatttcatgctctccgttatgtaatgaaccgggcctgtgccgtcaccgcatcgccgccgccagttctttgtctattatcaccgttacgtccctgcatattttcagaatgctgcacggcagcatgggatcgatatagtcatcggcaagtaattttccgattgcctccgccttggcagctccggccgcaatcagaactacttttcctgctccggtaatcccggccatccccatcgtgacggcttttttcggcacttcatcctctccgccgaaaaaacgggaatttgcttttatcgtctcctcttcaagctccacaacatgagttttagctgtaaatacatgggatggctcgttaaagccgatatgcccgttatttccgatcccaagtactaaaatgtcaatctcattctgttccagaaatctgtcatagtctctgcactggtcctccgcctgggctgccccgtcaatcagcataatattttcctttttaatattaactttagaaaaaagatgctgctccataaaatacccaaaactctgactatggctctttgtaagacctgcgtattcgtcgagattgatggtacgaacgcctgaaaagtcgatttttccggcccggtagtcctctgtcagacactgatacagccctataggggtgcttcccgtcgcacatcccaggaggggattcttcttattaataataacctcttcaaacatatccgctgcaatgcggctgctctcttcataactgccggttacaattaatttcatcctgtcattcctccgccgcaagcattgcaccaaccccgccggccggatgcaccagtttaaaataattcttgtcgatgccgttatacagcatacatccaattgatattgcatcaaacagagcgaaaaccgctgtcacggatgtcgttgaaaggcactggtaagggcaggcctccggtcctgtgctgagtatcaggttcaaatcactctccagtgcaatcggagaaccgggattctcggttacagtgataatcctggcgcctcttgcctttgccaccggaatcagatttatcatctccgttgtcttgccgctcttggatataatgataataatatctccccggcggatcattccataatctccatggggcgcatcggccggatttaagaactgggatgcccgatccacacagttgaatacctgggatactttctttgcacaggctccggaagttccgcagcctgtcgttatgattctcccctcacattcggcaatcatccgtacggctttcacatagctctccctgtctaccgtatcggccagttttgccactgcattggcttcgttggcaaaggtgtgcagtgcactgtcataaatttcatccgctgatatcatgtcagttccctcctctaaaatctttgactatcttcataaattccttcacccggttcttatccacctggttttcaaatttaccgtcatatttaaaggtcgttgcaaccaccgctccgtcggctatgccgagaaggccttcaattgtctccttccggcagcccgtattggccaggacaaccgtatccggcacctccgccttcacatcccggagcgtcgacatatcggtcggtgagccggccgtcaggccggatacgcagagtgcgtccggacggcagttgaaaaccgttgatttcgcaatctgcctgatctctctgtcggccaggtatctggctgcctccggcactatattaaacaaaagcttgacattctccgctcctatctccctctgatgccttaccacctccccgcagcaggtgttccagagtccgaaatcgcttgcgtatactccggtaaatatctctcttatgaatttggcatccacggctgcggccaaatcgagagaggctttcggatcccacaaaacattcacgccatacggcaccgttatgtatggctggagctcgccgatgatccttcccattgcagctacggtctccctctttacctcagtaagataggggaggctgtattcattgctgaacataatagcatcaactccgccttcctgaagagcgtctaaatcctccctggccttttcaaccacccatttgattcccttttccttattataataggggtctccaggcattgcctgcaaatgcagcatggatataatcgccttctctgttccgattacctctttcagccaactcataaatccgtatcctccttatacaactatcagatggggtatctttttatccagatattccctggtctccttttcgatgcccgaatctgtaatgatcgtatcaaattcttctatatcgcatatcttggccagcgccttctgcttaaacttgctgtgatcggctaaaagcaccgtccttttgccgctggctatcatactctttttaattcctatctccataaaattgctgttataaacaccgctcttggaattaaccgcatcggcccctacaaaagcaatatccacatacaattttctgaccagctcctccgctatatcccctatcagtacactgtaaccatctcttctgacccctcccgtcactatcattgtggaagaattgtccagcttaacggtcgaagcaatatccagattattcgtcaccaccgtcagcttcttgatgccttcaagctgctgtcccaaaagaagtgtggttgtacctgaatcaaggaaaatgctgtctccgtccttgataagccttacagcctctctggcaatcctcgtcttttccggtatcatggccttcatcttttcatcgtgatactcttcaaagcccgtccccttatgaagcaccgcccctccatgtgtgcgctccagaagcccggccgccgccatgtcatccaaatcgcgcctggccgtcgcctccgagacattgcaaagctccgatgcctccttgattgagatgctgaacttcgattttagataatccgaaatctgctgctgcctctgcgccggtattgaagttgtgaactgtgtcataattttctccttcctgtgatatacattatcacatattgcaattttttgcaatatttattacaaatgatttcaaaataaatcatttaaaattgcatttaatttcatttataacttttcttctgtcgtttcctgttatttgttgcaatattaaatgatttcccgcggcacctgtaacatctgcaggattgccgcgtaccgtaccgggcgtccggtacgccttaaattatagtatacctcagatatcggccctgcgcattcatttgtttgaaacatgactgcaattatttttgcaatcatttcaaaagagagcgccactcctgacattcggtcattgtgacttcatgccatttagcggcgctcccttttcaatttttttcttttctatttatatttttctatttagcttttctattttacgcgtcatctattcataacgccgcaaaaccgtctccaggcgctcaagcgctttgagaagaactgctttgggacaggccagattcatccgttcaaatccttccccctcttctccaaagcggtatccttcgtcaaagaaaagctgggcttcctgctgcataatccgctcctgctctttgatatcccagccgtaagccctgaaatcaagccattggagataagttccctccatttccacaggccgtactttcggcaggcgttcatttaagaactgcacaagcatctccttgttttcattgagcactgccagcatttcacccatccatgcatcgcatttcgtataagcgatttccacggcccggtaactgagggccggcagccagttgggatgaagcacttttgaaatctcgtcaagcagagcgctgcgccgttccccgttcctcacaaatatacatcccgacttgattcccgccagattgaacgttttcccgggtgacaggcagatcatgcagttttctgcaaactcttccgaaaccgacgcaaaagaggtgaatttgtacccctccatgataatatcacagtggacttcatctgagatgacaaaaacgttatttttcaggcatatctcgccaaccctcattaactcttcccgggtccagactcttcccaccggattatggggattgcagagtatcagcagacggcagtccggtttttcggccaattgctctaaaagcgtaaaattaatggtgtaagtcccatcctggcatatcaggggacagcggtaaagctttctcccgtttttacaaattccttcggcaaaaggcggataaacaggagtcatcaggatgacgccctccccttctccggcaaaagcccggataccgcagctgaatgcattgatcactccaatggtgtttatgagccattccggcctggcctcccatccgtaacgccgttttacccaggatgtaacagccgttctgtagctgtcttccggagtctggtatcccagtacaatctcatccagacaggcttttaagccttccgtaatctccggagggttcttgaactccatatccgcgatggagaatggtacgattccttcctccacattgggattatcactcttcatctgctcccacttcaccgagccggtgccggaccggtcgagaattgtttcaaaatcataggttctatgagtcttgttcatcttacgattgcctcctttggcaggattattttcgcgaagcgtgttactgttcgcggaaccgcgcttttcagcggggccgtgaatcgtaacgattatttcttcatttcaaacaggaaatgacagcagccgtctttaaagaaatgtttgtcatgggtacatttgaagttctcattatagccctccgctatggacgggtcaatcatctcgcagtaatggattccatatgcctcgtcgtgatcctccatccactgttttgcaaagatgcattcggtaaagagctgttctatggaatcttccctgatatcgttttcactgttaaacagctcgcttcttcccatatcatagcagggaagatagctctttgcatcgttctcatggcccatggccttcgcgcgctccgcgatattcctgccgcgctctaagccaaactggcggacgccttccctcactgctctcacaccttcttcaccgcaggctttctccacctcccttgtaatgtgggaaaacattttagcgaaaagtacatacatgtcaaccggctccaactctaaatccttgtccttcatcttcttaatcctcctcatctaattttctgatcatctggtataaaacgcggcttcccgccgccatggcctcataatcgatccattcatccggatggtggctgattccatccctgttcggcagaaaaatcatcgcggtatcccaaagctttgcaaatatcatggaatcgtggcctgcgccgctgttcagcctcatgctcgtaaaccccagttccttacagacgtcttcaatccctccggccagagctgcattcatttttacaggttcttttctggtcagctcccgcacttcaacatcgagggcatatttctcccggacctctccggcaaattctgtgagatgttccagaatatccctgagtatttcttcttcccctgagcggatatcgagagaaaattcacactctcccggaatactgttcatgctccccggcaaaagcgatacctgccccgccgtcaatgtcgctctgcccgaatacgtatcacatacataatcgtgaatccggcagatcaggtgaaatgcgccggttcccgcatctcttctaaggttcatcggaactgttccgctgtgcccggcctgtcccttcactttgacaacaagccacgacagcccgacgatggtatccacaacgccaatctgtttttcctcctgctccagaacgggcccctgctcaccgtgtatttccagaaatgctttgaccgcatcttctttcctggatacccccttaagatctccgctcagcccgtattccgtcatggcctggcgcattgtttttttgtcttctataccgataaattcatcgagctgttcttctccataaatcccggctataaactggcttcccaaaagcgcttttccaaaccgtgtgccttcctccccaatcatacccagaacctggaaggtgtggcgcagcggtatgccgctctctctgaccaatctggccgcttcagcggcgcatacgactcccgcaatcccgtcaaaggcccccgcgcatctgaccgtatccagatgggaaccggagagaattttcgccagtcccggctccgtgcccgtcaaagtgccgatgacatttcccactccgtcttcgtggaccgtcaggccgcagtcctccatcactccttttatgtaagccgtcccctccttatatgctgccgagtagctctggcgtgtggtaccgcaccggcatggctccgaaatgccctttaatgtctcaatctccgttttgagcctgtcctgcagcagtttatgcccgccgcccattctgttcgtgccgtagttttccaagctgtgcgtctcctttctttcatctttatttactctttatccagattttattttcctatcattatctctaaaatttcccggtcggtttccctcataccgtctttgccaagacggccgaccgaacgtatcgtctcctccacgccttttttgacgatgccgtccccggcccggaactgctgatcctgttcaatcatcagataccccagcagtccggcctccaccgacattccgatctttgccgcacaggacgccttcgctccgtcacagacaattcccgaagcgattgccagacagttcactatcgtatgggagatcgtcctcaaatccccgccgtttaaataggcaatggccgccccgctggcacagcctgcgctgaccgctccgcagtaagccgacaaagggccgattcccgtcttctgatgaatcgctatcagatttgataaaaccagcgcccggaacatcttttcctccccgcactttaactcctttgcatattcaatgacggggacagaagctgttattccctggtttccgcttcctgaattgatgataacgggcagctcgcatccgctcatcctggcatcggagcctgccgcagcccttgcttttgcgcggacgcgcacatcctgatccccgtatgcctgaaacagcaccttcccaatattcgcaccgtaattatgggcaagcccctcgtcggcaattgccgtattataagcgatttgacgggaaatcacatcttttatgtcctccagctttacctggtctgcaaattccaggatacctcccacagacagaagctttttttcctgactcaggcccgcgtcgtcccctccgcagtccatcgctttctcaaacaggcgcactccgttcttttcaaccagaactacattcgtgtgggcattcgcgatccggacgaaaacggaatcgtcccctttcttaagctgaacctggacatcgagcagcagatccgagccggcaatccccacctcgattatctctttctccacgagatcgcgtatctgctctttttcctcttccgtgacttcgctgatcacctccagctttttctctgattttccgccaaccagtccggcggcaaccgccgcttctattcccttcatgccgttcgtcccgggtaccacaacgctttttacattcttaataatattaccgctggccttgatttgtatcacatccggaaaagcgcccaggcactctctggcaatggctgaggcatatgcgattgtgataggttccgtacagcccagggcaggtaccagttctgcttttaatattgacagatacgcatcgtaaactttttgatccattcctctctcctctctcatttctctcattttcactatattatcgttttttaaactataatataattttattatctttttcccaacttgtcaatcgctttctttgtagttaagcaggtgaggacgccgccgggacggccagcggacggggtggtggggtgggtttatgagtctttcgtcccgggggaagtggcattgctggcaggagaaggagatactatagctttgttttcgcagtgcggagccggaagatgtcggcagtatctccttctcccggaaggttatcgacgggaatatgccttcattgcgcctttatgaaaggcgctagatttgatatctgcctgcggaaacacgtagtggccgcgacagggccctccccatttaaggttgaagacaatcagcggccgaaacggaccatgtccggtgtcgcgaaaacctccgcctgagtcttccgtccccggcgaaaaactgacccggggaagtaggcggaatcaattgcggaggggacatgggagtccgccggtgcttagcgaggtccctcacgagcttagcattccgatgcgcactccaaagagtgcaaacggtccccgcagcaattcattccggccggattccccctccacgaccaacctcccacgggggcggaagactcatatccccccatcatcccgtccgctggccgtaccggcgccgtcctcacctgcttaattaaatcagggcgattgctttttaccggaatttcatgtaagattgaatacagtacattttgggaggatttttacatatggaaaaagaagtgcgcctgatacagtcaatccagagggcgtttaatattatcgactgcttcaataacgacaataccgaattatcgctgccgcaaatcagcgaaaaagttaaacttcatattaataccaccagaggaattgtcaatacactggtagccaacggctatctggcctgcaacgccgaaaaaaatacatattgccttgggctggtttatattacaaaagcggatcttgcgacaggaaataatataaaacggctgagaaccctggccgccccgcgcctcaaagatattgccaaccggttccaggtctcggccctgctgcaggttatcacaaataataatatatttaccattgaaaatataagccccgatcactcccattatattttgaacagccggatcaatcttacctttgacctcaatgccactgcctccggtaaactgtttttaaaatacatcgatgagcctctacgggagtattatctctcacggatggaatttttcccttatacggcaaacaccatattaacccgtgaggccctggaagcggagcttgatacgattgatcaaaaagggtattccacagaatttgaagaaataggcctgggtatcagctgtgttgccgttcctattttgaaagaggacaatacactgttcggcaccgtcagcataatcgcctccagctctgtgattatgtccgtcctggatacagcgctggagccgcttcacagctgcgccgggttcatagccgggaatatcctcccttaaggatgttagtttcatatgttatacgtttatacattaaattatctgctacttctataaacgataacctgcacgcttcgcgcacaggtcaccgtcatcaatcaaaaaaggaatgcagaaggtgagacgtttaagcctccgctttctgcattccttttatattacctgctgttgttacaacggatggtacctgtgaattacatcattcccattccgccgcctgccggcatagctggtgtttcttctttaatgttagctacaactgtttctgtagtgagcagtgtggacgctacgcttgttgcgttctggagagcgctgatggttaccttggtcggatccaggatacctgcctccatcatatccacatactcttctttatatgcgtcaaatccaactccaaccggagattcttttactttattaataattacggagccttccagtccggcgtttgccgcaatgtggaacagtggggactcaagtgctttcagaatgatgcgtccgcctgtcttctcatctccgtcaagctcggaaacaaccttctcaacctcggctgccgcatggatatatgcggaaccgccgcctgcgatgataccttcctccactgctgccttagctgcggataaagcgtcttccatacggagttttgcttctttcatctctgtctccgtagctgcgccgacgcggattacagcaactccgccggacagttttgcaagtctctcctgaagcttctctctgtcgaaatcagatgttgtctcctcaatctgagctttaatctgggcaattctgtcggaaatttcgttcttctcgcctaagccgtctacgatgattgtgttctctttctgtactttgacggattttgcacggcctaactgatccattgttgtgtctttcaaatcaaggcccagttcttctgagatcacggtaccgcctgtaaggatagcgatatcctttaacatctcttttcttctgtcaccgtagcccggagctttaacacctactacagtgaaggttcctcttaacttgttgacaatcagtgttgtcagagcttcgccttcgatatcctcagcgatgattaacagcttagcgccggactgtaccacctgctctaacagaggaaggatttcctgaatgttggcgatctttttatctgtgattaagatatacggatcgtccaggttggattccatcttttccatatcggttgccatatatgcggagatgtaacctctgtcgaactgcataccttcaaccaggtcaagctctgtcttcatggtcttggattcttcaattgtgataacgccgtctttggaaaccttctccatagcatctgctaccatctggcctacttcatcgtcagcggaagaaatagccgcaactcttgcgatatctgcctggccgtttacagccttgctcattcccttgattgcttcaacagctttttccgttgccttcttcataccctttcttaaaacgattgggttagcgcctgctgccaggtttttcattccttcattaatcatagcctgggcaagtacggtagccgtagttgttccgtcgcctgctacatcattggtctttgttgcaacttcttttaccagctgtgcgcccatgttctcgaatgcatctgcaagctcgatttcttttgcaattgtcacaccgtcgtttgtgataagcggagcaccgaaggatttatcaagaactacgtttcttcctttcggtccgagtgttaccctgactgtatctgctaactgatttacacctgattcaagagcttttctggcatcaacgccgtatttaatttcttttgccatggttcatcaacctccaaattattatgtctttttagtttctactatttattcaataacagctaagatgtcgttctgttttacaacaacaaatttttcttcttccagctccacatctgttcctgagtatttggaatagataactttgtcgccgactttaacctgcatcgtgatctctttgccgtctaccactccgcctgggcctactgcgataacttcagcctgctgcggtttttcttttgcctggcctggtaacacgataccggattttgtagtttcttctgcaactaactgttttaaaacaactctgtcaaataatggcactaatttcattactgactcctccttactgttttgtcttgtttttatttttctttttcaaaatgtacttggtaatatgttacttttatttacaaaacaagttataccacgctttgttagcactgtcaatagttgagtgctaactttatatattttttacaatctttcgtaacagttcagacagcaatgtcatgatgttggggtcaaaaggtcttttgacccctttgataccggattgctccgcactgcgtgctctcacaatcctcaaaaacattcgcaatccgctcatttttctgcgaaaaatggcttcttactcatgtttttggcgggtcccaagattaaaaatcttcatgcaagcaagcttgcatcagatttccaaccttttgaccctggtatcatgtcatttcgttaagcaggtgaggacgccgccggtacggccagcggacgggttggtagggtgtgtatatgagtctttcgtcctgggggaggattgtcgtagtgtggggcggagggcgtaccttgtcgaggccactcagtgctaccgggtatgcgagatacgatatgccttcaatgcgcctttttaaagaattgcggaagatatgatatctgcctgcggcaacacgcagtggccgcgacagggccctccccatttaaggttggagacaatcagcgcccggagcagaccatgtccggtgtgcgaaaacctttgcctgagtcttccggccccggcgaaaacctgccccggggaagtaggcggaatcaattgcggaggggacatgggagtccgccggtgcttagcgaggtcccttacgagcttagcaccgatgcgcactccaaagagtgcaaacggtccccgcagcaattcattccggccggattccccctccacgacaacctacccacggggccggaagactcagccagccccctcaccacaccggacctggtccgttccggccgcgtcccccacacctcagttaaatctccaatcaagattcagccgtctccccgtctgaactgttacagtctttcttcttattaagattccgtccctctaaaactacccgccaaagcccgggctttcaaagctttataccttcctggcgcaatatacccggcttattctgagtgttacacccgctattttattacatcttttataatttattcttagaatccctttattttttagtaaatccgtattacaataagcttaattacagaaaggagtcttattatggcaaaaaaacactttggacgatttttagcatttgcggctattgcgggtgcggctgcggcaggaatctcctatttcttacagtacaaatcgttccataaagaactggatgaagagttccacgattttgaagatgattttgatgaatttgaagatacagacgataacagcagcaccgtaacacgcaattatgtttcccttacccctgacaggaagaatgaggaagcaacagacggccgcaacgatgaagggtctgatgtgacggcagacgaagaagtatccgctctctccggagagacaccttccggtgaacaggagtcagttcctgaagaagctgaagtttccgtggaggaggacaaaaacatcccggccgataccaccgtgactgttgaagagatgaccgaataagacggaggaacagcacacatgatacagagcctccttcgctccatggaacttctggagcttctgaaagagacaaatcataaatactccattgctgagctgtcggaagccacaggccttccgcccagcacgattcacagaatcctccagacgttctgcgaaaagaaatatgtgatccgcgatgagcatgcccatacctaccagttgggtcccgcattgatttcacttgggcgggccgctgccaacaatgtccgtattcaggaagccgcactgccgattctcaagaatctttcctataatacaagggaagattcctatctgattattcaggtgggcgacaaagggctggttctggataagatggacgggcctaaccatctgaaggttgtggaggaattcggatatgagatggatctccactgcggcgcgatccgcaaagtactcctggcttaccaggagccgaaatatatcgattattatctgaacaatattctggaccggccggaatcgtttccgcaaatcagccgcggcgccctggcttccgaactgaaaacaatacgggagatgggaattgccgtatcccacggtgaatatgttcacgatgcggtcggaatcggcgctcctattttcgggatagaaggcagggtttccgcatcggtcggcatcatcgccccctactccagagtggcggacgacacccaccttcatcatcttgaggagcaggttaaacacagcgccgccgaattatcctattatatgggacatacatttcagaaaaactgctgatacagtcaagacaggagaagccgcttaatcaaaagcagattctcctgtctttttacgtatacagctgagggattcttctcaggaatttggcactctccgtccgcatcaatgcccatgtatagctgctcgaacccgcggaggatgacgaagtcacaagggtgcgcttttccttcggggagcagaaggcccggccggcccggtccgttcctgacacgtcccccattctcaattaaattttctattgacatcacctatactctttcctatatactagacggagggaggaattcagatgaaaaacacacaaaacgagagaattcgggagctggaagaaaaaatatattgtctcgaaaccattatccaaaatattcatgaaggtatcattctcactgatcgaaactgtattatcaccgttttcaatccggccaaggcagagatggaacacatggatgccggcaaggctctgggagaaatctcctggcttgcctatgaacattccgactgggaatcctctgaacaccggcgcgtaatggacagcggaaaagcaatccttaacgcttacagaccccatgcctttgtgggccaggctcccgtctatattaattatgataccgtccctatcaaaaaagatggtgaaattatcggcgtctactcgatttgccgaaccgaatacactctgcgtaaactgctttatggactattagaacacaaacgtcagattcttgccgatgcagccgcagaagcagatccagttaatatcgcagagggaacacgatataccttcgcagatattaccggaacttcccccatcatgcgcgaaatcataaaggaagcacaagccgtttcaacaatgaatatgtctattctaatcacaggtgaaaccggagttggtaaagaagtcctgcgcaaagtatacataatctcggccgggagcgtcataaatttattgcaatcaactgtgctgcgattccggccgaactctttgaaagtacgctgtttggcacagtaaaaggcgcttataccggagcagttaataatatcggtttgttccgcgaggcaggagaaggcaccctcttcctggacgaatttaattcactgactcccctgaaccagacgaagctgcttcgtgtacttcaggagcgatgtgtacgcccggtaggtagtacaaaagaatttccggtgcaatgccgacttatctgcgcgtcaaacgaaaaccttcagactcttttagacgagggccgtttaaggcccgatctctattacagaatctccgaatattgcctggagataccgcccctcagagaacgcccggaagatatcatcagcctcagccttctatttgtcaaaaaatataacaaagaactcggcagaaatattctgcatttttccgacgagttgattcattggatgcaaaaccgggcctggtacggcaattctcgcgagctgcagcatgcgattcaaaatatgatgctgaaggcatcggaatttgacgataccctgaccctcgaagaccttccggtcgttaccaggagagccccggcccgccatcaaagtgaatcttcgtttcacaggataccggctgcagaacctgttaaagaggcagctaaagaacttacttcagaaccggtctccggtctgactgaaatcttaaaaacatatcagagagaactgctgatccagaccttggaaaaagagaactggaatatctcttcctctgcgcgtatcctccaaatcagcagacaaaatctcctggcacggatgaaacggctgcaaatatcatcgccccataaacccccttccgcttagctgtatgataaaatagcactgtaataaaatgttacagtgctattttattgcgttttattacagagatgttccaaaacctgataaatccgcgatagatgtaggtattttaattggcatgaaacttgctttataaaactatatcgaaactattcacccagtatgaaaggagtcaaacatgtcacaagtcagagacacaatacagcatgtgacgattgtaggcgtcggaactcagggttccatgattgccttccgcaatgccgtatacggaaaagaggtcacaggatacagccgtacccggacctccattgagaaatgccgcagcaaaatacgcaaatggctgaattattatgttgagacgggacgcttatcccaggcagaagccgacgcagccgaacaaagaatttcttatgccgaaagtctggaagacgcctgtaaaaatgcgcagcttgtcgttgaaaatgtaccggaaaagctggaagtcaagcaggaaatctttcggaagctggattccttatgcccgccggatgccctgctgaactctaatacttcatcccttttgatgagtgatatctgtgcctttgtatctcctgagaggaaggccctcactttttcggtggatcatgacgatccaatccgcaatgattatctggaaatgatgtggaatcccagtaccagcgaggtgacgaaacaggcggccctctcccactaccgcaccctcggcttcgagccgatcataacggagcgggaaatcaaaggatattcgattaacagagtctggagagccgtaaaaaaagagtgtctgtacctatgggccgagggatatatcaccccctcagaattcgaccgcggctggatgatggaatggcatacaaacatcggccccttccagcttatggatttgattggcctggatactgtctatgcaatcgaaaattcttattacagcgtaagccggaatgagagagacaagcctccggcaaagctgaaagccctgattgattcgggcaggcttggcatgaaatccggccatggtttttacagcggctacgatcctgaaacgggaaatctggtaacaaaatagacttcggaaagaggaatgattatgctattaacagatacccagcgtgatatgctggatggaaaatacggcaaaggcaaggcaatggccgcccggattcttaccgctgtgggagaaagtttccgcgctgtgcgccttgtgccggttacacgcgtccatgtctctctgagcgcccagggcgccgatatctggtttgccgaaaaaatggttcaggccggagctgtctgcgccgtcgctcccactgtcaatcccggatattccatatgttatttcaaaagccgctctatgctgtctcctgatgccgaagagaacatgaagcggacggaagatgcctaccgaagcctgggcgcttcccttacttacagctgtaccccttatctgaatgaaaatattcctatacggggggaaatcactgctttttcagagacaagtgccacgatctttgtcaactcagtgatcggagcgaagacaaaccgtgagagcgccgctaccgccctttgcgccgccattacgggctttacgcctgagtatgggatgctccttgatgataaccggtttgcagataccgctgtttacgtggaagccgatatgagggacgatttctcctactctttgctgggaatgatgggcaaaaaaataggcaagggcatacctgtttttctgaacctcccggtcgatcccaccacagaacagctgattgccctcggtacccagctcaatgtttcaggttcatatgagatgttccatattcccggtatcacccccggctcccctaccccggaggctgcgtcgggctataagccgccccggcacactgtcacaatcacccagcaggatctggacggcttgagggaggattatgctgcaagtaacaaaacaccggccgaatttgtaatgcttggctgccctcattatacttatgagcaggtcttgaaggttaatgaattcatgaaaagccgcctggctgtgattcccgtctggatcctgacctcccgccatgtcatcactcttgcgcgcagcttaggcgtttacgatgaattaaaaagaaaaaatgtgcagatgatagctgatacctgtattgacgagtcccctgtatggggttttctatccggcaaaacaggcttgagcgattctccaaaatgcgcttattatatggcatcttttcaggcacatattaatgtaatgagtacggaatgctgtctggagcatgctgtcaaaggaggtacataaatggctcgtttctatccctgtaagacaatttctccggggaacgcacaaggagaagccgtcatctcctccgaagaaatccttttttactttaccgacccggcaaccggccggattacagaacacggccactgcctggagggacagagcattgccggtaaaatcctggtatttcccggcggaaaaggaagttctgttgttcaggctgacggcctttacaaattagaacaaagcggtatgcagccggccggccttatcgttcaaaacctcgatacggtcctggtatctgccgccgtaatcatggaaattcccatggtatgcgaagttcctgactccctctgcctggctcttgaaaacggcatgacgttaaagattaatacagatgaaaatacaattgagcttccagattaggccaaccggccaaagatactattttcttgattgaaaggatgggtatatatatgaacagcaaaccagcaattaaaaccactttgaagtttattgtcatgtccctcatcggtatcctctattttttcgtccctctggttccatcggacaaaggaaagggcgttcttctcgtttattcggtaaatattatcaagtccgctctttctccctggctttccgcactggtcatgatatcaatcggaagcctgattcttttgtgtatcactgcccggcttacagataaattcccaacgctgacacgcctgtatgggggtgtaaaaacatactcgattgttttgtacctgatcggttttattctgagcggtatgaccatcctgcaaatcggaccggaatatctgattggaccggctgtcggcggacaggggctgggactggccaagaccgtgttagtcactatcgttgttgccggcctgatggttccctttattacggagttcggactgctggaatatatcggcgtactgatagaaccgctcatgcggccggtattcaaggttcccggatacgccgccattgacgccgtcacctcctttgtcgccaatccgaccctgggaatattctttacaaataaactgtataaagaaaaaaaatatacaacgcgcgaagccgccagtatctccaccaacttcagttttatcagcctgggattttttgcagtgctgaccgcaacggctaatatcacggagcattacggcaaagtgctgattgcctctttcttgctgtccttcgtaatggcggcaattgtcatccgtctcttccctctgagggggatgccggatacctttatagacggaacagaacgggaaggcgaagaacgcagaaaattcagcctgtccttattccgccatggatataaggccgccctaaaaaaagcggaagatacgcctgtttcatcggtttttgcaaaagctctgttggaagtgcttgtttttgcccagaaaatttcggcctatataatggcaatctcctccatcacctttctcctggtagaatacacttcgctgtttaatattctgggggttccatttatagctgttctgaaattatgccaggtccccaacgccgcagaaattgccccagccatgatccttgggctggcagagatagccatccccgccacattcatatccacactgtccatttccgtggaagccgccttcttcgtaatagtcgtatctgcgcttcagattatcatgttttccaacagcgccgtatctattatggagtcagaaattccgctggggattggtaagcttatcctaatcttttttatcaggacactgattgccataccaattgtttcggtcgtgatgcatatcctgttctgacaatcaggagcttttcgtactttcccataagcgaaaaaaagtgaccagccggggagctggtcactttaaggagaaggtatttcgttcttatggggtgtagcaaaaactatataatgtattggggggggttacgagtattataatagcatactctatcaaaaaagtgtgcacaaagattttcttttttcataacttttttgtaccattttgaataaaaccgttcacccaaagtgacagttcatctgtctgaactgttactactcaaatccaagcgccttcattttcgaatcaatccgctctctgccactgaaggaaaaagccgctttctgcacggctccctcgtcggccgtcagaaacatgaccatttcttccttatcaattacggctgtaacggtgtacgtctttcctccaaaatcaacctgacagcccgccgtatccaccgaaccgaacagggaccatgaaagctctcttgtaaggacacaatccttttttcccatgaccgattcgtaagaaccgcttaacacttttgccggaaatgccagggaaacagggccattgacataaaccgttcctacccccgcttttttgccggacagcggctcttttacattcccggcctctccgtaccgccatcctgctatattgagcagccctgtcatccctcccttctcccgttcccttatttcctccagctcttccatcgtaacactctgaagctgaaggtcccgctccgtgcggacctgggcatcgccggttctgcttccggctgctgccgtcagcattcctgttcctgataaaagaaggaggactacagccagaatcttttttccatatttcatttagttctcctccctttcatttccgatttctgtataggtatcagcttcctttgcccggaagctccgtcatcaggcgcacccggtcgccttccccgatcacccggtcactgtcggtgataaccggttcctcggccataagggggccttctacggccgccaccgtatcgccgcctgccagaagctccacctccaccttcgccgccttatattcttcccccaggatggtcttctgttttctcagcacaagacaataatatccgtttacatcttttctgagagcctttaccggaatcacctgcctgtagacctctccgcttctcagacactcaaaatatgccttttctcccagtacaccatatcctgccggaaggctcgcagtaaaagaaccggtctcctggctggtgaccagatccacctgttcgacatacgcctggattctttcgtcgcttcccgccatcctcacctgcagttcatcgccggttctcagtatttcatcatcctccctgtcaaaggttccgcgaagctttagcaacccggtggacaggacaacccgctctgttccggctatgtcttttcccgcctcaatctccacggtgctgaccgtaccatcgcagggagcataaaccatgccctggttttccatcagtattcgcagttcttctttttcttccttcagttcttccaaatcaagctgctttgcttcaatcctgagcgccgacagcttctttgcctgctccgcaccgagcgcagccgcatgatcctccttcgcagcattctgcagctccatccgtgccgactctactgcccactctgcctgtattcttgcatcctcggccgactccagggcctttgcttcctgtgtaacggccgactcataattctcttttaaggccagcttggcgctgtccgcctcgcggccggcccgatcaaagatatcgcccttgtcgctcatttcttccctggcccggtctatcttaagatcccagctttcctcctcggaatccaaatcttcctcataacggtccagcagttcccggagttcttccagctcgtcttcatccggctcctcctgtttctccaatttctctatttttttttccgtgtcctttatctttctttttatctcccggatctgtgaatcgcgctgcagttttgccgactcatagtccgtccggctctggtcataatcgttccggctctggtttaaaagttcgtcctccgacagttcgagccgcaattcataatattctttgattttttccatgttgagattatattcggcttccgcctgagctttcttcccattctggcgttccagtgccttttcggccattgccagggactggagcgctgcctctgcccttgtcactcccgtaaaactgtctgagccgatacgctctccctcgatttccagttccatttttttgatctctttttgcagcctcctcatcttgtcttccagggattctgccgaataagaaaacagtggttctccggccttcacggctgtcccggccatagcttcgactttctctacgttcagttccttaatcagggaaattgcctgcgtttctcccgcctccacactgcagtccccatccacagttttcatcacggtcccctgattcgcataggcgatactgacttttgccgtctcgtaaacatcaatcaccctggataatatcgtaaaaaaaaccatgcatgcaaaaaagcagatcagtaggcggcggtacaaatttcttttcattttttctttctcatccatacggcttcccccgactcctaatcttttttcgtgttccctattccttgataccggatgaggcaatcccctcctccagataggtctgcccgttgaggtacaaaagcaccggaggcgccattgtcaccagccccgccacaaaggccagggacgcattgtccgccgtcacattcggcagataaagcgataaaggccaaagctgcttattctttaaaaatgtcagcggctgttccagtgcattccagtattcaaaaaaatccagaagcagggctgtcataattccgggaaatcccatcggaacgccaatcctcaggaatatcgtccactcgcctcccccgtctatccgggccgcctccagaaatgatttcgggatcgattcaaagaatttctccatgatatagacaggaaaggtggagaatattccaggcagtataaccgccagatgtgtgtccagtatcctgaaacggtccaggaccagataggatggaaccatcattacctggaacggcatgacaagaagaatcagatacagcagaaaaatcgtttttttaaaccggaaatcatatctcgcaaatgcccaggcggccggcatgcctaccagaagctgtcctgccaggacgcaaagcacctgcaggcatgaattccaaaacataacaaagaagccgggtgagcggagaaacaaatccgcataaggttttaaagacggaaaatcaggaaccagagccggaagcaccggctctcttcccagttccagaacagcgagataccgccgtgccagttcatcctccggcataaatgacgccgccgccatcaaaagaagcggaaacaggacaaaaagcaggcagataaccagcaggaaagctcccaccagctttttcggggacggcgttttaaaacgcctctgttttctcaccattattcatctcctcccgccctgatgacaaagggaatcagaaaaataccgattacaatggttaaaaggactgccgccgcacacattttctgcacgtccagatttaaaaaccagtgattaaataaatgctggagcaggtaaatcctgtcgtttggataagatccggccacgatatatgcctcccggaataccttgaaggagttgatcacagccaaaaacaggatcatccctgccgccttcctcacctggggaatcgtgatgtatagaagcttttgcagccagccggctccatccacctctgccgcctcgtaaagctcatccgatatccctcccagcgccgccagccacaggagcatctgatatccggtgtttttccacaaatatgcgaatataagcaccgaaaaagaagcggggccgtaaatccagtcggtctgaagactgaacagttcatttataattccctgttcgcagaataccatcctccacagaagaacaacggacgctgccggcactgcgaccggcaggaccaggactgttttaaaaaaactctttttccggctgtactggtaaaccagcagggacaggaaaaaggataccgccatcagaatcggcagcgctgtccccataaaccgcacggtattcacagccgccaggcggaatgcctgattggccagaaccccccgatagacgccaagccctacgaagtctattcctctgctgtcaaaaaatgagcgtctcagcgcatcaccgaacggaatcatgacaaataccagcacccccagcaggctgggggccagaaacagccaggcccctgtagtttttgccgcttttttactactctctctcattgacataaagcttcatcttgctttcgatcgtctgaaccgcattttctatcgttcccttcccactcagataatctctggaaccatccacaatcatgtctataatctgcgtttcaactatggccggcacgctcacggtgcgcacaatcgcaagaatcatatcgcggtctgcctgttttggccattctccctcgagggcaatcccttccccgcccatgctcatagagacactgactgatttctccataccgctccacttgtcaaggctgctgcttctgacggaaaacccgtccctcagtgattcgtcctgcacctctgtgccgaataaaacgcggaggaattcttctgcattctccttatttccggttgatgcattgatgcctgccacaacactcggaatatagattccgccgattgattcaaaactgctgccgtttatctccgctgctgataacgggagcatggcgctgtcgattgaatcgaggatttcggctgctgccgcacatctgcctgatgcaagattaaaatcactctgccggccgaaaccgtatggtattaccgtattgtttactttcagacggtccatgtcggcctgatcatagcttacctgcacatttcccttctcaccggcgctctttactccggtaagccagcgggtcagtgcatcgccgtcaacggttccgttgtcgttaaacaatttattaaaacaggtatatgcggtcatgttaaggatattttcgtaaatatccggcgcgaaaagtgtcggtgttttatcgtattcagccatcagttccggatcctggaacgctgcgacagcatcctccccgccatatatcacaggcaccttgatacgggccggcatataataaatcttcccgtcttctcctgtaaaccctccccttacattgggcaggtaatcatccttatccttctcaaagagactgcttaagtccgccagaatacccttatttttatatgtttccatcggaagtccgtccagtatcaggacatcggcaccttttccattcaaaagctccgtattgagggcgcggatcacatcttccgtcaccttcccatactcgtcctctacggcaatcctgtaatccacctttatctgaggattattcttctgaaggatggccgctgcctggcggaccgtatagctgtctttcagggagtagaccgtcagtgtttcaggcggcaccgtgtctaccgtctcgtcatagtaatagtgaataagcttaatcctggaatttgaggtcgaataaatgccgtaaaaatcattgtccgtcccctgaaaaaatttcatcaggtacatatcctgccgtcccatggaattcaggcttccgtcgattaactgctcccaaagcgtgccgtttcttccgatatggtaaagtccggtcgcatctgcaacataaataccgccttcctcatcggtaaagacaggcatctggcctatcatcatattgctgcctgagccattttccggcatattataacgctctgtaatccttccggttgtgatattataccgtacaagctgctggttactcatcgtcacgtactcatcgcctgtcaggcaggccggaatcctgacatccagtccagtaaaatcctgggccagtgtaacgctcttctttccgtcaggcagatagacattcgcctccgagctttctgaaaccaaaatctctccgcctggcccaattcctataaaatcggggattactccataactgcggccttcctgaattttaaacacctccggaagcagttcctgaactgttccgtcttcctgtaccgtccagagatggaacgtgtaattttcctggtcgaatcccccaaaataaagcttttcattttgatccatgaacatttttgccggtctgatattaccaagcggcgctatagcctcgccttttgtccaggaggaggccgcatcatagctgtagaatctgtcattcccctcttcatcggggatagcaaacagcaggctcttgtccttcttttgtaccacacccacataaccgttctctgcaatttcttcaggaagcgcaatctcttcttccatgtaacggcctttggccgcctgacctcccggcgctccgctctccgcggactgggacgctgctccggtgccggactgtgtcccggatgatgtgccgctgctgcaggccgtcagtaacgacatagcgcccaacatgagcgctccggccgctgcggtaaacattcttccccgtttcccgacttgttttctttttttatttatcgcgtattgaactatgctgtttttcataaatctcctcctgatttggtctgcgtatgttatatctttattttacaatctgattctctaaaaaaactggaaaaaactccttttattttttagattttttagagatttgtgtgctaaacttaataataaggtaaagtttcgaaatacagaacacattttttcacatttagatacaggaacaggatgggaatatgaaaatattattgatagaagatgatgaagtcttatgtaaaacaattcagatgtcgctgacgaaagccggatatgacacggaaatctgtcatacgggaaccgacggctttctctatgcctgctccggcgcatatgactgcctgattatcgaccggatgctgccggaaatggacggccttactcttttacaggcactgagaaggcgtaaaatccagacaccggccatcttttccactgcgctagacggattaaatgaccggattaacggacttgacgccggagccgacgattacattgcaaaaccctacgctatagaagagctgctggccagaatacgggctgtcacaagaaggctgggacgtattgaggaagagtgtaccctcacctttgaggatctcgtttttttgccggagcacagagaactgcggtatcagaatgcatctgtctccctctccaaaaaagaatcctccctcctggaatattttttcagaaatcccggcaggacactgaaccgcgaagtaattctgggctatgtatggggggcctccagcgaagtggaggatggaaatctcgacaattacatttacttcctgcgccggaggctgcgcacgctgaatgctcccgtcaaaatcactacggttcatggagttggctaccgattggaaaaaaataattaagcaggtgaggacgctgccggaacggccggcggacggggggtgggattgggtatatgagtctttgggcccggattgaggattgtcgtgatgggggaatccggtcagaatgaattccttcggggaccgcttgcgctctttggagtgcgcagcggtgctaggctcgtaaaaaacctcgccaatcaccggcggactcctatgtcccctgcggaattgattctgcctccttcctccgggaagaggatcggcgggaccaacgactccgccaaggatatcggccccgtccgctggcctgcggcggctgagtgtctcacgctttaagtggtgatggggggccttgtcgcggccaccagatattacttgacttgacaatctgggacctgaccggatgaacgtagtggctgcgacaagttcctcacccccttgaggcaagaggacaatcagccgccggaacggacagcggacagcgcgataacctggatctgagtctttggtcccgccgatcatcttcccggggggaaggaggcggaatcaattccgcaggggacataggagtccgacagtgcttagcgaggtccttcacgagcttagcactgcttcgcactccaaagagcgcaagcggtccccgaaggaattcattctgaccggattcccctttcacgacaatcttcaatccgggcccaaagactcatataccaatcccccgtccgccggccgttccggcggcgtcctcatcgactcaatcaaatcgctatgaaaggataaccatgtttaagaaggtacaaaaacagttgacaatactctacactgtccttaccggcagtatacttatcatacttctggcctttatttcttaccgcaatatttcgctcagggagcagcagcaggagactgacttccataacctctggttctcggtcagctcccgcctgcagtcctactccttcatcagcgacgcttatctggcgcagatggaagtcacaaaccaggccgttatttatatagaagagaatagttcgcccctcttcttctccggcgcatggacgcctccgactgagagagaacagcttataaaagcggcagtcactgcggccggacaggaaggtgtggatcccacacgcccgcctgtctcgtcctccgccagccagaccagcctgctccgcatccagggccgcaaaggcgattggtattacgggcgtgttatggtgctgcccacagcgaagggcgctaaaagccttctgatgctctcctatattacaccgcgatccgtcctgctgcgccagggtctttcactctttgtcctgaccggagcggccggaattctcggcatcctggttatcagctggtttctgaccgggcgggcgcttcagcctgcaagggatggaatccggaagcagaatgaatttgtcgcagccgcctcacatgaactgcgttcccctctggccgtcatccgctccagtctctctgcgctggaaagtgaactgcccggggaaacaggcaatcagaatcaaacggtcacactgagacagctcataaaaaattccgacagggaatgccgcagaatggcgagactagtgggggatatgctgcttctggcgtcctccgacgccggaaactgggaacttcactacacacagactgaaccggatacgcttctgattgaagcttatgaagctttcctcctgctttgcagggaaaaaaatataaacctcatactggagcttccaaaggaaccgttcccgccgcttcttgccgaccggcagagactggagcaggttatcacgattctcctcgacaatgccatctcctatactccggccggaaaggaagtacggctgaaaatgtataaaaaagaaggcagcaggcggatcagcgccggttatttcagaaccgtaattgaagttgccgacaccggaaaaggggtgcccgatgagatgaagcagagaatttttgaccgtttttaccggggagatgcctcaagaaaagataaaaaacattttggactgggactcagcattgcaaaagagctgacagagatgcacggcggaactctggccgtccacgataatccgggcggcggcagccggtttgttgtgacgcttaccctgcagcaggcatgatgtcttcccgtttatgagatatgcgtttgacaaagtaaaaatgtgcttgttgcgattatttgatattttgtttgacttacctactgctcctaacatacaattaaatcagaaaccggagggccagtatttcacctatctttatagaaaaaagcattctggtgatatgtcaagaactttttgaagaagattttgatatgtttttcagaaaaaagggtaactttaacagaccttcggtatattttacgtataaccgaatgtcagttcgactcaatattatattcggtgtccagcttttcgccggtgtacagttggtttttgaccagcaatccaaaaacgagtcgtactaatttacgagatgtaagcgcgagtgctcttttgtgctgatgtttggttacctcagcatattttctggcatagaaatcagcatattcagggatgtgcttcctgacgctgtttgccgcttcgccaagatagcagcgaagatagggatttccggctttcgacattttgttgtcctcagaagtgaaatctccggaatcacccttaggccagtaaaggccggcatatttggcaagggcatcggatgaatggaacacggttatatcgcctatttctgatagaattccggatgcccatatcggacctattccaggtatggattgaaggatgagcagggcgttagggttcattccgttgatgcatttctcaatcgcctgctcgatcagcttgatttctttctgataggcgtggatgcagttaaacgagcttgccagtgatatgctcagtggttcatacatgcacttgtctaaccggtaggaatccctggctgccttgcgcaggagttccgaagtttttgataggtcagagatgcggttcctgctcttccccgcaaggaaggtaagcagctcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtgcggcctaccctgccgaagtccgcgatgagatatgcatccgtgggatcggtcttttccattccgatataggattttcggtaattcgaagcggcctttgggtttacacagaatacgtaaggcctgtagggcatgagaacctcgctggccgacaggaagtttgaaatatgcacgctgtatacagaagtagattccagcacgataagaaccgtatccaggtttttatgcttctgcatgcattcggcaatcatatttacaagctgatcggcgcctggctggttattgccaaacgacgatgagatgtatttgttttcctcaaagtccatggcatagacggcattggtctttgagcttacatcaatacctacaaacaaggtggacatatagttgagctttaacatgatatcacctccattccgatggggatttgtgaagcctgaagcaaaaggtttatcctgtgccgcatacggtgaccgaaccctcgcgcaatgagcatgcacccagtcagccttttttgctggggctaacggctggggatgaaaattctgtgtcagcggaatgtgccgtatgtgccaggctgaatgctttcaaagcagtctcggacgaagccggctgaaaggaggagaagcagtgccttcggacatcagactctacctgatatcataccacaggatctacctatattgaaatgtaactatcaactgtatagatgggaatcgggatgaggggagtacctcttagatatccttaccatttatacccaaaaaagaataagtctgtaagcggtttttcttgcttacaaacttattatacgaggaggaggtatatgagcaactattatcaggataatttaaatgcaaatggactctaccaggtatatcagaccgaacttccaagaatccggcaatatcttcaggcagaaattgactacgtaaaaaaagctctgaccggcaatgaacacatccttgaaattggagcaggatacggacgcatcatgaaggaactctctccggccgctgccgccgtcacaggcattgatatttcagataattccgtccagctcggaaaagaatacctgaaaggctgcaccaactgccgtctgctgacaatggacgctcacagtctcacttttgacggtgagtttgacgtggtaatctgccttcagaacggactgtcggccgttaaggggaatcccggcgaactgatccggggctgcctgaacgcactaaagccgggaggcacggcgtacttcagtacatacagtgataaaatctgggaaacccgcctggactggttccgggaacaggcccgtaaaggcctgctaggcgaagtggatgaagaaaaaacaaaggacggcgtcatcatctgcaaggacggcttccgtgccgacaccttctccagacaggatttcatctccctgggagaggcatccgggtgccgctatgaggtggatgagacggatagctccagtttgtttttgattatttttaaacattgaggtggatgcgggcgggacggccggaggacataatggcagaacgataacctgcacgctctgcgcacaggtcaccgccaccaatataaacagcagtccgatgcataccagatggcatgtaccggactgctgtttttactgcaaatcagtaagaacatcctccccatcctttaatgtcttatcatatttcttatgattaaatatcagaatcgcgcagctgattgtcgttccaagcataatgatccccgcaaacatgccgccgaaattggcaatgatcttaactccgttaacgccaaccgtggctatcataatgtaggcaagcgtcataacgataacgccccaggcgatttttaaccaggcaggggcttccgggctgtcaggcgtgattccctgtgtggaaataccggccattgcagtcatatttgaattgcaggcagtgacaaccgacagaaagataagaagcaggaacagcggaataatcacctgtgagaacggcatgcttctcagcattgaataaggaactgcctccacacctacgttattatatacgccaaccagatcaaccgctccgctaatctgggcaaacagggagtttcctcctacaagaatcatccacagagcgcttaccattgcacatacgcccacatataatcccagcgtctgtttaactgttcttccataggcaatccgtcccatgaaagctcccgatgtcggcgcccacgccatccagctcgcccagtaaaaggtggtccaccactgcggccactggctgtcggcggaggctcctgtcaacagggatttttcaaagaagtttgcaacaaatccgccgaaagcctctgttcccagattgaatacaaatgcagttgcaccgaaaaacaggaggaaaagaaggaaaacaacatagccgtagacattgatgtcggcacataatttaatgcccttctgaagtccggaaactgccgtagcaataaagatggctgcgataacaatggccacaatcatccacatggatgcattgcttggcattccggtcaattccgcaataccgcctgacatattcatgattccctgtcccagggaacctgccatgcccgctccgatgcagaacagggtcatggcatcgataattttagaggtgtttttattgtccgcatattttccaagcaccggagccatttcggaggtgatggaaaacggcctctttgcattataatacataaaaccgaagacaaccgccggaaccgtataaattgcgtatggaataaacgtccagtgcaaaaacatcgtctccatggaaaacttaagcgcttcattgctcatcggaagaattcctgtcagctccgtgggaggagcgctcagatgggcaattggctccgcaggtccccagaaaaggacgcccgccgccatagtcgttgtaagggcaatcgtaaaccatgagaatgtggagatttccggttttgcatcctcacctccgattctgacatttccaaatttagaaaatgcggccgcaatagctacgagaactgtgcccaccgcgataatactgaagacccatcctacgtttgcaataatccagttattgatattattgatcaggtttaaaaatgtatctttgctgataaggctgacaacaacaatcagcagcagcaatataaacggcgggaaaaatgtcattttccgcagctgcatgttaccgttcttattcttttccatgaaacttcctcctcctttgttgtcttgaccatttctcagttactgtgaacagtaacatttatctatctgacagaattttataatcttccggatgccggtcggtcagtacggtattaaattcccgttcctttgcaactctctccaagtcaatttcctgatataaaattccttcctcctcaacatcaaaagctgccagtacttccccgattggactgataacctgacttttgcccgcaaaaatttcctccccgctctgtccgcagcggttaaccgccgccacataaagcagattatcaagagcgcggcaggcaagatttaaatcccaccattctttaaaataatggctcgccctccatgcagacggtaccagcatcagctcggcgccgcgaagcgccagaatacggctcgtctcaggaaagcatacgtcataacaaattacaatacctatctttccaagctttgtattccataccggatactcgtttcctctctggaaataagtccgttcatcccccaccgggtgggatttggaataaattccctctatctctccctcatcattaatcaacactgccgtattttcagcctcaccgtttgctgccgcataaataatcggggcaaccagataaaccgacagctccgccgccagtttcctcataaccgtaaccgattcgccgtccaatggctccgccattttcttcatggccgggatgtcacttcccagatatcccgtattaaatgcttccggcaggcaaatcagtgaagcgccgtttgcagcggcttccctgaccatctcagacgccttcctgagatttgcttccttatctaaaaaagcgagatccatttggattaatcccaatttatatttcctcacccttatcccctttctgctgtcaaaaagactcccgtttggcggtgaaaatcgcccgtttaccgacttttcaccgcccgtctgatggcataaattacaatcgtaacagttcagacagcatgaactgctacttgcccccctgaacttacagatatttattgaaaaactctcccattgcatccgcaagagcctcaaacttcggatctccgtcgaacatccactcgttatgtttaccttctacataataaagctctttcggttcctttgcaaggcggtatgcctcctccgcctctattttgtcatggagttcattatatctgccatggccaacaaacacggcttttggagccagtttcggaagcgtggcttcgatattaaaccggaggaaagactctgcgtaaacgctggacattggggtcgggaattcttcgcctgtcgtctgattggccttttctgaaacaccgccgtcgattctcttcagcgtctgatcaacatagaaatcaccgctctcgtcaatattcggataaaactcatagggatgtctcagcaccggatcgcctgttgtggcacgtttaattttatcatcctccagagctctcagcattttatggtacttatcatttcccattcccatacgcatccagcgcacgccgtcaacaaaggaattaagtgtggcaaccgcctttaccgcatcctctcttgccgtgacctccacacatacggctccgcctacgccccagccgattaaaccaattctctgcggatcaatctcaggctgcgctttcatgaaattcaccgctgccgccacatcttccacttccctctccagtgtggtatatttttctcttccctcgctgggcttaaatccacggtaatcaaaacccatgcatacataccctttcgcagtcatcgccctggagaacaaggcgggatataccatgttaagtcctgtccatccagagtttgcaataatacacggccgtttctccccatccttataatcatccggaagatataccgttcctgccatcttgtcaccttcactataaaatactacttcccttgttttcataacatatctctcctttttgtttaaatactaaatttattccttgtttttctctatatccctgtcgcaatgtcactatacatcttttttcggtatatttcaaccttttgtcgttgaaatattcctttttcatccttttcaccaattatactcggctgtttttgttcatttttacaacaaaaaggttcaaatatacctttttacaattctattaatttctttttgttttataattatttgacacggatttccggctgccgtataataaacataacattactgtttaaggcatgacgaaccgcccaatagccgcattgcggtctgaaaatccaactataacgacttaatgaatgaaaaggagacgttgtttatggaaaataacattctcgatactatcacccagataaaagatgtactgcccaaaaagcagagaacactttgtaattttattgttttgaattatgtggaagccggtatgatgaccgtagccgaactggcggaacgttccggagtcggagcaactaccgttatgcgtcttgttaaaacgctgcattatgacagctacagcgatttccgccgcgctttactcaatgtatccctgaagaacaatgcctcgtcttacattggaattaagaacagttttcagaaagcttccagcaactctgattcagatatcctgcatgcgctctggtatgacaccactcatacggttgaaaatttcattacgccgaaaaatatcgagcagcttgacaaggctattaccctgatgatggaggcatcccgaatcaatctgctgggacttcgctcctcgcgtactgtatccctgtacctggaatcggccatcgaccgcttctatcctcatgtcaggcagctcagcaacgaaagcgaattcttgtatgataaaatattccgcctgagtgcggaggaagatattattatcattttttcggcctggccctgtaccaaacggacaattgacgtatctgccatctgccgcgatcgccacgtgccaatcattctagttacaaacacgtccctgaatccgattgcccgctatgccgatattgttatcgatacaaactctgtcaacagcggctgcggtattcttccgcttatgtttatagcagaggccctcactgccgaactggcccgccggctcggccccgattccatgaaaatacttgaggaactggaatcagaacttgataaagccgatgtctttatgcggtaatctctttcatgacgggccgacacgctgtgcgccgcgtgaacaggccgccgtcttaatagggaggaaggtaattacgattttacaaagattttcagcccataaaaatcagaaaatataagtatgtctaccatactaaaggcccaaataacgggccttttatttttcggttcgaatcgacgcggccaatcatcttatcgccttggaatatcccccgtctgtctcctattcccgctctcttgcaacgtcattctatcgccataatcaataaaagcataacaataccatttaaaaagtatttttattccgtttttaaaatacagtatttactattccttttaaaggtgttactatatccttatctcaaaaacggtatttttattcttattggaggttttatgaaacaaatacactttatttcggaatcttatcgccaaattgcaaaagagctgattaaagggggttatgatctccacacacataccgaaccctctgcttttcaccgggcattagacgattttgatctcgtccgtgaggccggagaggcgggcatggcgggtgtcctgattaaggcgcattacggatgtacggcggccagggcagctctggtgaatctgcacagtaacagcgccgcaaaggcatttggcggcctggctcttaaccaacctgtcggcggtctcaatccctatgccgtagaaaactccctgaaaatgggagctgtcatcatctggatgcccaccagagattctgaaaactgcctgaaattcggcgatatgccgggagattttttccaacgccccggtatctcaatttttaatgagaacagagagatgaaaaaagagatattcgaaatctttgatattataaagaaatacggcgcctgtctcgccacgggccatcttgatacgaaagaggcctatttactgtgcaaaacaggacgaaagcatggtgtcaatatgatattaacacatcctgaatggaatcgcaccaaatccagcggggcaattcaaaaagaactggccgataccggagtcctgatcgaaaaaaactggctgaacattgccgaaggctctgtttctgctgaagaaatggcatctaatatcagaaattcgggcgttaatcacgtatatctgtccaccgatcggggacaggccgggtttgaacatcccgtggaaggaatgctttgttttatagaaacccttttggcacaaggtttttcagaaaaagaaataaagactatgctatgtacggttcccggttttattgtgagccggaatactactggttaacagttcagacggccattgacaaagcctgttttttattatacattgaacacagtttagatatgttcacaagcgagtcaagaaaggaatacgacagatgaaaacactactcctctatgcaaccaagtcaggcgccgcccgggaatgtgccgaactgctggcaaaggagctgacggactgcactgtatgtgatctcaggcatgccatccccaatcccgaattatttgacacgattatagtcggctccggcatccggttcggtaaaatctacaaaccggctgcaaagtttatccagcaatataaaaatgtactgcttactaaatcggtttctttctatttctgcaattgcgaaactgaaacatttcagaatgcagtcgaaaaaaacattccgaaggaactgctcatgcatgcggattgcataaaatccttcggaggaaaaatgccgtttaaaaaagcacagaatatgaactggctgaaaacagaaaacaaagatgccttccttaaagccgtcctgccggataaagaaaagataaaactaaatttcaagagactgacctcggctgaagatgccatgtatccagccgcaatggccttatatgccatgagtttccccgctcatgagcagagggaagaggcatctcagaaaaaaattctggaatgcagtcaataccattttgacttgatttatgacggaaacgattttgccggagtcatcttgtactgggaaacagagaactttatttatgtagagcatttctgcattaatccaaagatgcgaaaccgaagatatggccagagggccttggaatggttggggaaaaaggagaaaaccataattctggaaatcgatccgccctcggatgatatttcaatccaccgaaagtcgttctatgagcggtgcggttttaaagagaatgcattttcacatgtacacccgccgtatcacaaaggaaataccggacatgagctggtaatcatgtcttcccccggcaccttgtctccagaagattatgagtcgtttcattcctatctgaatcatacggttatgaatggactcttcccggcagatatgccgtaagcttccaaacacgtcgccggcatcgctggatggagaaggagatattgtggttttgttttcgcagggcggagccggagagaatgatatccggctggactgcttcttcgagggatagctctaagccagaggaaggcaaagccccccggggttacggacaaattcgctccgaactccgaatgagttcgaagttcaagttgtcccggattttgcccttgtagggctaaaatccgcccggcgcgctttgtctccctctgcctaagagctatcatctctcgggcgaacgtccttccggatatcattctctccttctccgccggaagatgtcggcagtatctccttctcccggaaggttttcgccggaacgaaagactccgccgggtgtatcggccccgtccgctggcctgcggccgctgagtgtctcacgtgttaacacgtagtggtcgcgacagggtcctccccatttaaggttggagacattcagcgtccggaacggaccatgtccggtgtgcgaaaaccttcgcctgagtcttccgtccccggcgaaaacctgaccgtgggaagtaggcggaatcaattgcgtaggggacatgggagtccgccggtgcttagcgaggttcctcacgagcttagcattccgatgcgcactccaaagagtgcaaacggtccccgcagcaattcattccggccggattccccctaacgacaacctccaaccggggacggaagactcagccccccctcaccacaccggacatggtccgttccggacgcgtcctcccaacctcagttaaatctccataccacgccaaattgagcggaatttaaaccggtgatattcttccggccttaattccgctcattctattataaacatcaaatttacaaccaatatactcatacaactgcatcagcccatatccaccctatatttaacgcatatggaagcactgaatgcccgcgacaaggtccgcccccgcacttaacgcgtgagacattcagcggccgcaggccggcggacgggcgatacccttggccttgagtctttcgtcccggcgaaaacctgggcttggggcggaggggaagataaagtctgcagatgccgttgaaatccatcgctgattggcgaggtctcttcgagcctagcagcgcgatgcatttcacagagcgggagcgtgctccgcagactttatcttcccccgcagccccataccacgacaatcctccaccgggacgaaagactcatatacacaccccaccaccccgtccgctggccgtaccggcggcgtcctcacctgcttaattaattacggttaatctccgaaatgccgtctatctcctgatgttcagccactccgcaacctgagttctgattccctcgccgtcgaggccgtacttcctgagaaggtctgccgcaggaccggattcgccaaaagtatcacggattcctatcttatagaccggaacaggaaattgctctgaaagcacatcacagactgcgcttccgaggccgccgataatggagtgttcctccacggtcacgactttacctgttttgcctgccgaaccaatcagcagatcttcgtcaatcggcttaattgtgtggatattaattacttcggcgtccactccgtcctctttcagaagctccgctgcctctaaagcggctgaaacgcagagtccggtggcgacaatcgtcacgtcacggcctcccttcagcatgatacctttgccaatttcaaatcggtaacctggtttatcattgataaccggaaccgccagacggccaaatcgcaggtaaaccgggccttcatggtcataggccgcctccactgccgctctcgcctccacgtcatccgacggattgatgaccaccatctccggaattgtacgcatcagagcgatatcttcattgcactgatgggtggctccatcttcacctacggagattccggcatgtgtggccgccacttttacattcagatgaggatagccgatggaatttcgaatctgctcaaaagcccgccccgccgcaaacattgcgaaagtactggcaaaaggaacctttccggttgttgcgattcccgccgcaatacccatcatattgcactctgcaattccgcagtcgatatggcgttccggaaattccttcttaaacactgccgtttttgtcgcctctgccagatcggcgtccaggaccaccagattttcatgcttctttcccagttccaccagcgcgttgccatagctttcccgggttgcaattttcttcttattttccatctgcgccacctgcctcgtcaagttctttcgtagcctcgtcaagctctttcattgcctgggaaaactcctcgtcattcggtgccttgccatgccacgaagccttattttccatgaaggaaacgcctttccccttcaatgtgcgggcaatgattgccaccggcttgcctttaacggtcttcgcctcgtcaaatgcctttttaagctgctccatatcatttccgtcttctacgcagattacatggaaattaaatgcctcaaacttcttatcaatcggataaggagagcagacgtcttcgatggagccgtcaatctgtaaattattgttatcgacgatcacagtcaggttgtccagcttcctgtgtccggcaaacattgccgcttcccagacctggccttcctggatctcaccgtcgcccagcagcgtgtatacatgataagaatcgccgcttattttcgctgagaccgccatgcctgccgccgctgaaattccctgtccgagagaaccgctggacatatcgacaccgttaatatgtttcatgtcgggatgcccctgaaggtaggagccaatatgcctgagtgtcaggagatctttcttcgaaaaatatcctctctcagccaatacggcgtagagtcccggcgcattatgccctttggacaggacaaaacggtctctgtccgctttcttcggctgggccggatcgatattcatctcttcaaaatagaggtatgttaaaatgtctgccgccgacagggagccgcccggatggccggatttagctgcgtgtaccgccgtcacgattcccttgcggacttcatttgccttttgtttaagttctaagagttccattgcggattcctttcccaattatttgccgaacactgcctcataatcagctttgaatttctcaattccctgatcggtcagaggatgtttaaccatctgcatcagaaccttgaacggaacagttgcaatatctcccccagcctttgcacactctgtgatgtggagaggatgtctcgtggatgcacagataatttcagtggaaatctcagggtagttatcaaaaatctgaacgatatcataaatcagttcggtaccatttgttgaaatatcatccagtcttcccaggaacggggaaacataggatgcgccagccctggcagccagaagagcctggtttgccgtaaagatcagggtgacatttgttttgattccttcagcagaaagcaccttcaccgctttgagaccctcagccgtcattgggatcttcactaccatattcggatggatttttgcaatttcacgtccctctgcaatcatatcctccgctttttccgtagtagcctttacttcacctgaaatcggaccgtccacaatctctgttatttctttgattacctcattgaaatcgcgtccctcttttgcaatcagggatggattggttgtaacgccgcagatgattcccatgtcgttcgcttctctgatctcgtccacattggctgtgtcaataaaaaatttcatgtctgcctccgcctttcattctccatttttcagttagttataagtaaaacagacagcattctttaccgtctgcctaccacaacattttactatatatttctatttatgcaatcattataggttgaattgttggaaaaaattaatttccctggccataataggcccccggcccatgttttctcagataatgtttgtcctgaaggcactggggcgccggctctgcctgcggattaatccactcacactgagcggccatcttcgccacttcttccaataccaccgcattatgcactgcgttaaatgcgtcggttccccatgtaaagggcccgtggtttttgcagagtacgcagggaactgccatacaatccaattttctctcctcaaagacatccgcaatcagaatacccgtattcagctcataatcctcatccagttcttccttggtcagattcctgacacatggaatactgccgtaaatataatccgcatgggttgttccatagcatggaatatcacgtcccgcctgagcccaggatgtggcccacggactgtgagtgtgtacaattccgccaatctggggaaaacagttgtacagctccagatgggttttggtatcggaggaaggattcagatccccctccaccttatttccctttaaatccattactaccatatcttccggttttaatttgtcgtaatcgacaccggacggtttaatgacaaacagccccctgtcacggtcaattccggagacatttccccaggtaaatgttaccagaccgtactgcgggagctgcatatttgcttcgtaaaccttttttttcaaatgttttaacatttttctcacctttcttatgaattttaattgtttcaacccatgctcggtatattatcgaagtacggctgcatcctatgcggacacgtggttggcctcatggcagtgggggataccgacttttctcccccacttaacatgtgaggcaatcagcggcggccgcaggccggtggacgggcggcacactcggcaggagtctttcgtcccggctaaacccgcagcaccaactcacgacaaaccttcccaggggacgaaagactcatataaatactccacaggccgttccggcggcgtcctcacctacttaattaatcaccgcagctctctccactgcaagccctgccttaaagcattcaataaaccggtcaaatccttccgcatctatggcatccggctctattctgactgactcttctccggcaaacacctttgtctccagataatgatccagcgtctcattttcttctttgtcacgcatataagaggccagcactgcgataccccaggctccgccctctcctgccgtctccattacggatacgggtacctttgcggcatcagccatgactttctgtccgacccctttggtcttgaacaggccgccgtggcccatcaggttatccagcgttaccccttcctctttaaagaggatatcaaggccaattttaagtgtggcaagggaactgtacagatgggttctcataaaattggcaagattgaagcggctgtccggagtccgtacaaatagcggacgtccttcttcaaagcctgtgatcggctcacccgacagataacagcaggacatgagcccgccgcagtcggcatcgccttccagagccttgttatacagagttccaaacagctgattcatatctgccttcattcccatcgcctcagaatactctttaaaaatattcacccaggcgtttagatcagaggtacagttattacagtgaaccatgcccaccaggttcccggaaggcgtcgtcaccagatcaatctccggataaaccctggacaattctttctccagcaccaccatcgcgaaaacggaggttccggcggagacatttccggttctcacctttacactgtttgtcgccgtcattccggtaccggcgtctccctccggcggacagagtaaaattcccggtttcaggagcccggacgcatcgagaagcgccgcaccttcttccgtcagtgttccggcctcttcgcctgcggtaagcacctcaggaagaatatcccggagcttccaggaatattccttcatcatatcaaggccgtcaaactggtccaccatcgtttgattataatttcccgttgccgtatcaattgggaacatgccggaagcgtccccgactcccagcaccttctttccggtcagtttccagtgaataaaacctgccagtgttgtcaggtaatccagctccgtcagatgagcctccccatttaagattgcctggtacaaatgggcaatgctccagcgctgcggaatattgtactgaaagagttccgtcagcttttcggatgcctcctgcgtgatggtatttctccatgtcctgaaaggggccagaagaacaccgttcttgtcaaatgccatatatccatgcatcatggcgctgattccgatggaaccgatcgttgtaagctcccgtccgtacttctcccttacatcccgggccagatcccggtagcaggcctggaggccggtcatgatatcctccatcgtgtaggtccagatattatttaccaggcggttctcccactgatggctcccctgtgcaatcggggccgtcgtctcatcggtcagtacagccttgattctggtggaaccaaactcaatcccaagcgctgtccttccttctgtgatactaagtataacctgttctgtgctcatattcatcatccttctttgaactgtcactgtcactgttcacagcgccgctgaaaagcgcggttctgcgaacagtaacctgtcgaaattacgttaatgaaatttgtaatacgcctcattccactttaattcatttctgaaccgtcggatatctgtgtctttgtcaatatatacggcctcgatgcccatgcaggccgcccagtcgcccatctgatctgctgtcagatcataggagaacgcggtatggtgcgcgccgcccgcataaatccatgcggccgcccctgtctccaggctcggctccggcgtccagaatgcggtggctaccggcagcttaggcatctccttctccgcctttttgacaaccacatcattaataatcaggcggaaacggtcgcccaggtcgatcagggacgtggcaacgccgtggccttctttggctgtaaatacaagtcttgccggatcctcacggtctcccatcgacaacgggcactcctttatcgcaatcctgccgtccgcaatagtcggacagacctccagcatatgggcctgaagaatgccctcgcggcccttcaccagattataggtataatcttcaaagaaagtcgtcccctttgcgtcctttgtattagccgccattatcttcatcaggcggaccatggccgccgtcttccagtcaccctcggcgccaaaaccatagcctttctccatcagtctctggatagcaaggcccggaagctgtttaagccctcccaaatcgccaaaatgcgttacaatcgcctgataattcttctcctccagaaaacgctcaaacccgatttcaatctgggcctgaaccgcagcatgagcacggaattctttctcgtccctgccttccggaagaatatcatacttgtcgtaatactcctccaccagcgcatccgtgtctgccgccgaaacggaattcacagagtccactatctcatttaccggatatgcgtcaatctcccagccgaacttgatctgcgcttccaccttgtcaccgtctgtcacagccacatttctcatattatcggccacgcgcattacgcggatatgggaagattccatcacgcccactgccgtgcgcatccatgaggctaacgcagcctgaacttccgcatccgcccaatagcccacaatcacctttctctcaagccccattctgctgacaatatggccgtactccctgcctccatgagccgactggttctcattcatgaaatccatatcgatggcgtcatagggaatctcacggttaaactgagtgtgcagatggcacagcggttttctgtattcctgaagcccgaggatccagctcttggccggtgaaaacgtatgcatccacgtaatcacgcctgcgcattccggatcctgattcgcttcattaaaagttttccgaatcacttcattcgtgataagagtcggtttccaaaccacctcaaacggcagattcccgcttttattgagttcctccacaataatcctcgaatgctccgcaacatgggccaggcactcgtctccgtagagatcctgtgaaccggtacagaaccagaatttataattttttgctgtaacaagcattttgttacctcctgattttaataatatataatttcactgataagatcaatatgttggttgcaaaaataaggacgccgcaaaagcggccggaagacggagcagaggtttgtgaatgagtctttggcccccctatgacggtttgtcgcagaggggaatccggccagaatgaattgctgcggagaccgctcgcgctctttggagtgcacagcggatgctaagctcgtgaggaaccccgctaagcaccggaggacgggacaaaaactcccctgagtcttcagtcccggcgaaaaccttccattgatcctctccgcagctccaactggcggcactacccccgggactgaagagtcatccaaaacactcccactcccccgtcctccggccgtaccggccgcgtcccgcctgccttaaataaaaggattctcccccggatacatcatccccttaggctgattaaatgcgacatcctccacgcccaggtacttaaatacctcgaaaagaatttttccatagtgtccgaatgcaacggcaccgtggtgcggataatttttacctatcagaacgttgcggtagaaccggcccatctccggtatggcaaacacaccgatggagccaaagctctccgtgtcaaccggaagcacctccccctcagccacataggcgcggagtccggcatccgccgtactctgaagacggaagaaggtgatatccgatggcgtcagatcgccctccagcgttccgaaggtgtattcttccgggagggttctggccatgattttctgatttctcatatcggctttttttagcttcgtaatcggagtgttgccgcagtggaatcccataaaggtatccgtctgggcataatcatatactccctctatcctcttctgatacatatcggacggaacggaattgttgatatccagcagggttacctcatcctccgatgcgcagattccaatatactcggaaagcgctccccagatgtccgtctcacaggcaaccgggatccctttttccaccagccgggaattaacatagcatggaacaaatttaaattccgtctggaaggccggccagcatttgttcgccattgccacatagttccgatggcccttatggccttcgatccagtcctccagcgttatctcatactgtgcgagctttttaaggatttccggaattttattggcgcctcccagctcttttgccatctcctccgccaccgcgtcaatccgttcatcctccgcatgtgcattaaaggatgcgaagagatccagctccgagttttcctcaatctccactcccagttcatacagacacttgattggcgcgttgcaggccagaaaatcctgcggccgcggcccgaaggtgatgagttttaaatttcttaggcccaggatgcatctggcgatcgggataaattccagtatcatccccgccacttcctccggggttcccaccggataggggggtatgtatgccctgatatttctgagcgccagattgtagctgcagtttaacatgccgcagtaggcatccccgcggtcgttgcagagcttatccgccgcatcctcggcagcggcggcaaacatgaccggtccttcggtaaagtattttgcaagcagggtttccggcgtctcgggaccgaaattgccgagatagacaacgagagcgttgcatcccgcctttctcacttcctcaagcgccttttccatatctttttcattttcaaccgtagtcggacagttataggcatccacccctgattgggccagttcgccgcagactctgtttttccggtctgtggagagggcaatcgggaaacagtcgcggctgaccgccacaacccccagttttactgtcggaatattcgctgttttcatctatgcatttcctccgtttttcggtgcagtcgttcatcatcatcggttatcggttatttcttctttttcagcattgtcaatatggactgaagcacaataaagaagcagagaagggctgctatcgtgatacgcgtccaccaggaagataatgttccctggaaggtgataaatgcttctatggttgccttaatcatgacgccaaatagggtccccacgacgttgcccacaccgccggtcagcagtgtcccgccgattaccgaggaggcgatggcgtccatctcaaagcctttggcctgctccacgaatccgcccagtgtattcaggcagaacaggacgctgccgacgccgcataaaaatccgtccagaacgtaggctttcagtttcaccttgcgcacattcagtcccagcatcagggccgactgctggcttccccccaccgcatagatgctgcggccgaacttcgtgtatttcagcataataaaggctgcgacaagaagaacaagggcgataatgacggtcggatagatatagggctggatcatcatgccttttttattcagatacccgccgaaaggcagatagattttggcttttgcccatgccatgaaggtctcattggtaatactgatcatgtccttcgaaataatggcggtcatgcctcttgcaaagaacatgccggccagggtgacgataaagggctggatatccatataggcgaccaggaatccctgtacgagcccgaagacaataccggtaatcaggacaataatcacggccggaaccgccccgacgccgcccttttccatcatccatgcgagcatcatacagcccatggcgacaaaggaaccgacactgatatcaataccgcctgtaatcattacaacggtcattccgataccgattacgatcaggcccgcattggaaataaagagatttaaaaagttctgggttcttgcaaagccctgatccttaaataaaatacagccgaccgcatacattacgaaaaacagtacaattgtaataaggagaaggaagctggtctgattcagttgttttttattcttcattatgctgcctccttttctgcgagttttaactcttttttcttggtaagtgatttgcgccaccgttcaaatcccggtgactggagcgttacgatgataaccacgacaatcgctttgtaaacaggaacctgatccgaagatacatgcattgcgtaaagtgttgtcgtcagagcctggatggtataggctccgatgacggagccggcgatggagaatttaccgcctcccagtgagttgccgccgatggcaacggccaggatagcgtccagctccatgttaagcccgatattattggcatctgcggagtaaatacggctggaggcaatcagtccggccagaccggagcatagtccgcagtatgcgtaggtcaggaagataatcatgactgatttgattccaatcagccgggaggcccgtttattaatgccgaccgactggatgtacatgccgagggccgtctttttcagtattaccgcagtgactacgactagcacaaccgccacgataaacggcgtcggtacgggaaccccggggaacgaggagccgagaatcttgtagctgtcaacacggacataggtaatctgtccgtctgtaataagctgtgcaatccctctgcctgccgtaaacatgatgagcgtggcaaccatcggctggatattcagtttggaaaccagaaatccgttaaagcatccgattaaaataccgaccgcaagcgcagcgagaaatccgagaattaatggattggcaaattccgttgccgccctctccccgcctgacagaatgttgcagcatacagccgcgctcactgccataatggctccgacggagatgtcggttccggccgaagaggacacgaccagcgtcattccgatcgccaggattaccagctctgaagcgcggttgatgatatcaatgatgtatccgtacagaaccccgtctctgactgagatggcaaaaaagttcggtgttgtgataacattcaccagcaataccagagcgaggcagaaaatcggcagaaacagccgctgtgatgttattttcttcaatgtatcgtttttcatattactgacctcctgcaatggttgacataatcgttgactggttcatttccccgccgtcaagctctccgaccttcccgccgtcgcgcataaccaccatacggtcgcaggttcttagcatctcctcaatctcggatgaaatgaacaccactgccatcccctcttccgccagcttcacgaccagcttctgaatctccgtcttcgttccgacatcgatacctctggttggttcgtcaagaatcaggaaatcgggatttgtcaaaagccatcttccgataatcaccttctgctggtttccgcccgacagcgatttaatcggagtctcgcggctggctgtcttgatctggagcatttcaatatatttatcggtgtactcctcctgctgctttctgctgagcaggcggaacattccgcgtttagcctgaagcgccatgataagattctccctcacggacaaatcggcgataattccttcatttttgcggtcctccggcagatacgccattccctcgttcatggaggtcagaggatgtttggccactaccttcttccccttgatgaacagattgccttcatcggagcgttccgcgccgtaaagaacccggaccgattccgatcttcctgaacccagaagcccggtaaaaccgattacctcccccttgtgaataacaaggtcaaatggttttatgtaacctttcctgcccagcccggctgctttaatgacgatatcctcatcactgtgggccgcccccttgtctttctctcccttgattgcggccaggtcgtcaaaatccttgcccatcatctttgccacaagctgtaccctgggcagctccgccgttgtataccggccgacaagctggccgtttctcagcaccgtgattttatcgcatactgcataaacctgttccaggaagtgggtaacgaagatgattccaactccctccgccctgagcttcctcatcagctcaaaaagcttttccacctctccgtcatccagcgaggaagtcggttcatccagtatcagaacctttgccgacatatcgacggcgcgggctattgcgatcatctgctgaattgcgatggagtagttgtcaatcgtcttcgtaacgtctgcatttatatcaaggctgccaagcagctcgcttgctttcctgttcatggtcttccagtcaatcagtcctccctttctcggctctctgccgataaaaaggttttctgcgactgtcaggttgggacagaggttaatctcctggtatacggtgctgatacctttctgctgtgcttcctgggggctgcggttgataattgtgtggtcacagccttcaatcatgatttcccctgtttcaaactcctcaactcctgtcagaactttaatcagcgtggattttcccgcgccgttttcacccatcagggcatgtatctcaccttttttcagggtgaaatccacattctgcagagcttttacacccgggaatgtcttatatatgtgcctcatttcaagaacggaatccttttccataaaagctttgcctcctcttttttaattgctgcccattattttcggcatcaaaaaggagacgcagggaggaaacctaagcctccggccccacgcctcctgattaatcaatcaatattgggctatgtattatgattaatatgctctttcttttaagatgttttccagatccatgcttgtatcgaagtaagcttcgtcaacgtactgaatcttttcaaccgtctcgcctttttccagcttctggatgatttcagccacacgtggtccgtgaagcgggttgcactcgaaggttgcgtttaagtcgccagcgatcatggattcaaatgctgctttaacagagtcaaaaccaactacgatgatgtcaccatccggtccgcatgtctttcctgctgccttgatggcatcgatagcgccgaatgcttcgttatcattctcacagataacaacatcgatgtcgtcgtagctctttaagaaggactccataacttcctgtcctttagcctgtgtgaattcacctgtctgcatgtcaagcatcttccagtttgaatgctctgcaaggacgtttgcaaaaccttccgtacggccaacctgtgcggatgcaccgatggttccctggattgttacgatgttgatttcttcgtcgccgcgtccctgtgcctctaagtaatcagccagccagtttccgcatgtctcgccttcttttacgaagttgccgcctacccatgcttcaaaaagggaatcgtcggatacctgcatcatacggtcggaaagaataaccgggattcctgcttcttttgcttcttcaagaacggtctcccatcccgtctctactacaggagctactacaatgtagtcaacatcctgctggatgaaagaacggattgccttaatctggttttcctgtttctgctgtgcatcatcaaagataagcttatagccgttttcttctgtaaatgtggatttgaaagattctgtgtttgcagttctccagtcggactcagcgccaacctgtgcatagcccacggtgataagctctttatctcctgtgtcggctgccgcctcttttgcctctgtctcttcgcctgctgcctctgtctccgccggtgctgctgcctcagtcgccggtgccgtctctgccggtttgctggagcatgctgtcatggatactgccattgctacggtaagagctgctgataaaaatctttttttcatagtacttcttcctccttgtttttaagttgccattgttgacttgcagtgaaagctctgccttgcgtgcctttcaccgccggacacggtgaaaagtgtttttctcttcatcgctatgtccttattataaaagatgctccgtttttttgaaacagagcatcttttgaaaaaagttaaaatttttacactgattcatgccggatttccgttttctaccgcctgtatggcataaaacttgtgatttttttcgaaaagtttatgatttttttcgatttggcacacaaacgtatcatttgttaagtttggccgaaggctgaaccgatattatggagatttaactgaggtttggaggacgcgtccggaacggaccatgtccggtgtagtgggggagtctgtctgagtcttccgtccccgtgggtaggttgtcgtgaggggggaatccggccggaatgaattgctgcggggaccgtttgcactctttggagtgcgcatcggaatgctaagctcgtgaggaacctcgctaagcaccggcggactcccatgtcccctacgcaattgattccgcctacttcccccggtcaggttttcgccggggacggaagactcaggcgaaggttttcgcacaccggacatggtccgtttcgggcgctgattgtctccaaccttaaatggggaggaccctgtcgcggccactacgtgtttccggcaggctgatatcagaccttccgcaattctttcataagggcgccttgaaggcatatcgtatttcccgcacacggaagcttttagtggcaacgacaaggtccgccccccgcacttaacgcgtgagacattcagcggccgcaggccagtggacggggccaatccccccggcggagtctttcgtcccggcgataaccttcccttggggcggaggggaagataaagtctgcggatgccgcctaaatccatcgctgattggtgaggtcttttcgagcctagcagcgcgatgcatttcacagagcgggagcgtgctccgcagactttatcttcgcccgcagccccataccacaacaatcttcccccgggacgaaagactcatatacacaccccactaccccgtccgctggccgtaccggcggcgtcctcacctgcttaactaaatctttataatattgaaggccgaactccaacgttcagaccgcagcggttacgcccaggtatactttgatacacgttccgatatccttttccgactcaaccgtgatatctgctccctctccatagtacatacgaatcctctgggccacattgttcaaaccgaagcctccctttttctttacttccatattcctgtttcccttcagcttctcccgcagactgtggagcgccggtccgtccatcccgatcccgtcgtcctccacctcgaagacgattccgtttctgtcctcgtatccgcggaccgttatcgtgccgcctccccttttattcttgataccgtggtacagggcattctctacaatgggctggagaatcattttcagtacaattttatctttaatagacggttcaatattgatattgtaatccaggatatcctcgtatcggatcttctggatcttcagatagctgcggatatgcgtctcctcctcggcaatcgtgatgaaatcattgcctcccgaaagtacggttctgaaaaaatcgctcaggtcggtggtcatctccaccacctgatggttattgcccccctccgccatccatacgatggagtccagcgtattatagaggaaatgggggttaatctgctcctggtgaagcttaagctccgcctccctcaggctcttctgctcctgcttcgtcttctccatcagaccggctatctcatcgctcatccggttcagcgttctggccagcacgttgatttcctccaggccgcacattctggcccttgcctccagttctccccgtccaagccgttccgccgtctgcttcaggttattgattggattcgtcaccgactttgtaatcatcaccgatagcgtgaagccgacggtcagcactccggccagtatagccaggaagcctcccacaatctgctttgtatggacctccagttctttctgcagatcctccatcttgagtatttcataataggtatactgggtgatgtaatcctgaatcatggaacaaagcccctggatatcattctcccagattgaaaagttctcgtcataggtgcccggcttctttgaattatctatcatcttgctgaccgcattctccaatgaatccagacaggataaaattcccctgattttgatatcgctgtcagagccgggcgttctttctatcgtattatcaaaggcaaacctggcggaattaatcatattaatcggatttttaaccaccgttgcgtaccggctcattccctctataatatccccgttttcaaactgtcctgcgtcaatcagtccgatcataacgcggtacattgaatattccatgtcctctttaaacttcagattatattcattggccgtcttaagatttgccatgatattcttataggaattggaataattgcggatcatccccaggatccccagaaccattccggtcagcggaattgctatcacaaacaggagaagggtcaggcgcagcttcaacgtaagcttcctcagacctttttttctttcctcgggctgttcctcatacctattcccagccgctgttttgcgggttgtgaatagggactgctcctctgtcatctgactgctgtcttcagctttcatttttaacttcctttgctttgaactctttgggcgactggcccgttatcttcttaaacgtggagctgaaatagtgcggatcattgtaccccacccgctccccaatctccgccgtccttagcgttgtgcattttaacagcccgcaggccttgtcaatcctggacttcgtaagatattccacaaaggactggcctgtttcctgcttaaagatggagctgaaatagctggggctgacaccgatatgggtcgctatcatattcagagaaaaatcgctgttgctgtaattctgcgctatgtaatccttcgcatccctgatgagggtcccgtaacggtcgtttgaggcccggtccctcatcgtcagggcaaaaatgaagagatccgtcaggtacatcagagtcgtctccacgtttgtaatcgctttcggtatcaatttgatatcttttcgctccggcggtatctcgtcagcgttcacattgattccctttaaaaactcctggacacagtaaaagatatccatcaccatatactggcgcagcagaagggatttataattattctcccccaccgcggcaaagtattcctcgataaacagcctgcattcatccagagagccgagcttcaggaaatcctctatcagctttctgtcgactccgctgtaatcggtcttatccagaaattccgtatatttttcatagcttacaaaatagcgctccagaagtttactcttctccctctcttcccggattgtctccgccacctttttcagcgcgtcaatcaggtttgcggaagtaaccggctttaaaagataatcgctgattccaatcttgatggcttcctttgcatagtcaaattcattgtaaccgctgaggataataatctttgtctggggcagggcctttttaaccagccggcttagctccagcccgtccataaacggcatctttacatctgtcaggagtatatccggctctgtcttcaatatcagcggataggcgtactccccgtcacccgcctcccctgcgaattcaaagccgttggcattccagtcgatattgtcccggatgccgcggcggataattgcctcgtcttctactaagaatacttttatcataaattcccccgtgtaaacacaatttcatcccgtgttctctttatccgtaacactgaagcagtgcggttacgttctctgccgccctatgtatatcttatcacagcctttagtgaaatacaattttcaggtgcaaaagacgcgcgctgtttgttggcgttaagagtgcaaacggtccccgcagcaattcattccggccggattccccctcacgacaaccttcagccggggacggaagactcagccaaagcctcaccacaccgggcccggtccgttcctgacgcgtcctcctgtctgcgacagcagaattgataaaaaaataagcacaaaaccggccagtgcaggaagccggtaccgctcccccagaagaattgcgctgaatatgctcccaaataccccctccaggctcagaagcacggctgctttcgtgctgtctaccttttcctgacagatgatctggagggtatgcccgataaatattgaaacaatgcccaggtatgcggccggaagaactgcagccggcggtattataaagggcgtttcctccagcggaacaaacaaaagatttacagtaaacaaagccagaaactgcagacaagtcaccgccttcggcctcaccgtgccggagagctttcccgtaactgcgatatgaaccgcatagaggaatgctcccaggaacgacagcagatccccggcattaacagccgtgatattgttaaaatccaccgtcagcaggcagaccccggcaaacatcatcagcgcggaaaacagattgctgcggcccggcttttttttcgtcagcgcccaggatagaaagggcaccattaccacatttgttcccgtcagaaatgcgcagttccccgacgatgttatgcgtatcccataagtctgtaccagaccggctgccgccagaatccctcccagcagaaaacctcccagccattcccgccggctcgcccttctaatcacacacaggaaaaataatccggcgcaaaccgccgaaaaaaaggaacgcacaaccacaaactgaatcggtgtcaaaagactcatcagatttttataacacacaaatccgctcccccaaatgagtgcggtcaaggccaggagtatttccgccgccttttctgtcaactgtatcttcaacatatacctcccactaaactgcaaaagaaaaccggaaaatgcatctgcattgcccggttttcccctgtcccggccgctgcggttctttccgcccgcaaagcggccaaccttttcttctgcttttcagacacactcacgtattatatgcgcggcgccgtttcggattaatacagatacggcttatcccacaggttcagtgtcgtgccaagtcccatttcctttgcctgatgatatacggtatggccccaggccacatcataaaccggcatgccgcccattccaaagagaatcttctcttcatcatttttcctgcccgcaatcttgcccgcggcaatatcgcccaggttctcgatcatgtcctcggtcatcctgccctccgcaagccagtcaagataatacgttccgatcagtcccatgattggatgatacggatatttaagttcatcgctccacgcttcgtacattttccagttatccaccacacggcgtgcgcggttcaggacaaaatcgggatccaggtctattcctgccggcagtgagacatagacgcccggcttcagccattcctcctcaatccgcggatataccttgccggaggttgccacattgaccacgtcggcttcccgcacagcctcttccacgctgcctgcaagttcgattgtatggatctgcggataattctgacggatataagcggccagcttttctgatgcggccggataaatatcatatattttaactgtatccagttttgtacatacatcaatcagagacatgaaacaggtacggctgataacacctgcgccgatcagtgcgcatactctggattcaggcctggccagatatttcgctccgactcccggtatcgcgcccgtccgcaccgcactgatgaggttggccgacatcagcgcctcgggagcccccgtatccgcattgttcagcatgaccattaaaatggagcgcggaatgcccttttcaacattgtcgcggttggaaccataccatttctcaccggctatattgaacctgccgcccaggtaagctgtcatcgccatgaaacggcggtcaggcccatttttcggcatattaggaaattccggctcgtcagggaaagaaatcatgataccatgggaattatggtttttgccgcccatcacatagtcgcctcttcccataagatcgaagacctcccccattacctccacacagcggtgcatatcggttactcccgctttcaccatttcctcctcattcaaatacaggaaatcaatctttgtactgctcataatacgctcctccttttatatttttatttaataaataattgttgctcttactcctctgtgattccaagcgtcttccgttcccggagcggcgccgtataccacatctttcctcctatcgtcacagccagcgatatgacaaatgccagtgaaaccagacctacgacaagccacccttttcctgcgatcagcgcggccggtatcaatgaccagaaggcaatctcaataaagttgaggaatggggtcatagccacatcctccaccgtctttgacttattctccggatctacaatccgaagaagaacaaaaccgatagcaaacacgccggtgcagtaaccgaagcagaacagggaacgttcaaaccagctgtccttattcataagatatccaagcggtatcacggtcaggaaaacgcacaccaggccggcaattgttaagatgaccagcggaaccgcgtattccacaataaccgtcagcttgatcgaggcaattccgaaaaacaccagataatccgtggccgtaccggatatcttctgattgatattggtatcaatataatcgtagacaggcgtcttccgaagcgcaaagaagaatatcaaagcaatcaggtacgcaaccgtaaagtccggaatccccttcaataaatggaccgcaataatatttgcgttcagatagtacccaagcccggcaatgccggccacaattgccagatgaaaacacagtgtgtccagtgacacggagctgattgtttcctccccgatagatgtcctgttatcctttgatacaagcccggttctcaaatctcctgaaatatatttaaaatccttgatatatccggtgtaccccttgctcgtggcccatttaacaaaagccaggccgccaaaaatccccgtcagtattccgatggttgcaaacgtcattcccaaatcggtcgcttccggccagccaagctctgcaaaggttgccccgcaggccgccgccgtgccgtgtcctcccgtgaagcccgatgccagcaaaattccgatgccctgatttacctcggggttcacagctttaatgacagtgagcgtcactgtaatcgggatgataaactgcagaaagaaaatgacaaaccggtacatgttgaagctaagcaccctttttacctcttcacctgcccccttcgtctcccccatcttaaatccattgactccgacaatggtaaaaaccagaatgatcaacacccccgcgtaggatccaatcgaggtcgaaaacggcaggattcccagtccctgttctcccatggccagtccgataaagccggcgatcatactggccggaacaaagaatttctgaaaaacaggaatttttgcacgcagcagctgcccggccaaaatcaggattgacgcaatagccacatcaatcaacagatcatacacactcataaaatagctcctcctgataatagtcaataagtaactgttttgtgtagcttcacagttaccgtttccagttacactataaataaaagaaatagctgcgcagcatttccgtatttatccgttatgcggaacgggtgttaaccttcttctccgtccccctcctgtccccctgaagagtgtaaagtttttttgtgaaagccatcccctctatgacagccagaatcaactcctgtttctcggtggagagcttactggccccctcaatgattgcgtcaagacggttaatgttatcctccttattcatcgttctcctcccattatttgtattgaaaaatcgcacatttgttttataaatgcatcatatcacgcataatttgtgctgtcaatcactaattttgtattaaaaatccattattgttttgacaaatcatttttcttatgttatgattcaaatattgcatattaatctaaattggtatctgttccgtaccgtgtttgtttaaaatttatctttcaagaggtgggaaatgacaattggagaacgattaaaaatagcgcgaaaagcgagaggatatacccaggattccttggccgaagcactgggtatgtcccgcggcgtcatcacaaatatcgaatacggcagggctgagccccagacactggttatcaaggctatttgcgatatcctgcatatcagccagacctggctgatgaccggaaacggcaatatggacatcgattttgatttggaaaagagcgcgcgcctgctgtcctatatttataacgctgctaaagatttgactgtggaagaacaggattatattttagatttgatctacacattccagaaacaccgagattcgattaagaagtaataagaacgaatcccgctcgcgggattctcgcgccgagcgcggccgcatagcggcatattacatcttcgcgcgagtgcgcatcctgcccggagggctttttcatatcataggaacacctatgatatgaaaaggccagtccgttttcatacggaccggcctgcggcgctgcacgaatcaaacagcgcctctgcctcacagaggctgttaataacacaaaaacatttcttttgcaccgcttcatccggcacagtaagatccggaaccatgacagggatacagcctgctcggtacgctgcttcgattccattgacactgtcttcaaacacgatcgtattaccgcacccggttcccaggcgttttgccgcacagataaagatatccggccacggcttcgcgtgtctgatttcatcaccacagataacagctttaaaatattcctgaatacccgctttttccaaattaccgtgtgccgttttgctgtcacatgcggtggcaactgccataggcagctctctgttctttaaaaattcaagcagggaatataaaccgggcttaacgggaagtccattctcctctatctcccgggcggcgtagttaagccgtatctcccgggcccggccgtaatcaaaattctctccgtaccgttctttgaacattttctcagcatccgtccggttacagccccggatccgggccaccatctccgcgccgatcggatatcccaggattctgccggcctttttccagccctccagaccaagcctttccgtatcaaacatcaggccgtccatatcaaagattacgccgtccgctttcatatcagggcaatcagcttcagccagtctcccggacaggcgtccagatgcgcgattgcctgcggaagctcctcaaaggaaacgattttagatataatctttgccgcgggaacacggccggtggagattagctctgccgcctccgcaaattcttccgttgtaccggtccgggaacccactatctgcaattcttttctggtaatcactgccgtcggaagctctaccggcctgttgggccatccggtgagcgccactctgcctgtcggcgcggcatagtccagggcgtttctgactgcggcagcggaaccagacacctcggatacacactccgccatccgcccgccggtaactttcctaatatagcccggtgcatcttcggtctgcggatttaccgtatatttgattccaaaagtctttgcaagctccagacgctgatccacgatatctgccattatcggtatacctccgtaagccagcgccgccattccggccagcatgccgattgccccggccccgataattacgatatgttcaccttttttcagcttcaggctgtgaagcgcatgcagggcgattaccagcggctccgtcacggccagctcctcccatgtcatggaatccggcaccttcaccatatggctcaggggatgagcaaagtaccggctcatactgccctgcgtctggactcccagaacctccagcttttcacagcagttggttcttccctgggaacagggataacaggttccgcagtagagataaggatccagaacgacccggtccccctttttgattccgtagcggttttcgtcctccacctccaccacaatcccggcggtttcatgtccaatcaccagcggataagacacattagggcttttccctgcgtaggcatggacatcggagccgcagactcccagcgcctttacctcgataacagcatatcctttcttccactttgcatccggaatctccgacacatagatttctcccggtttattaatttttattgccttcatcatttttcctttcctcagaacggatcatcactgtcattcagatacatccgggcatcacacgccgctgtaggccgtatatcctccgtccacgggaagcacggtgcctgtgataaaagatgatgcttcgtcattcaataaaaacagcagcgctcccgcaagttcctccggctgccccagacgcttcatgggtgttccctctattatcttcttaagccgcggtgtcggtgtcacaccgtccgcctcatagaagagcgcctgtgtctgatgggtggacaaaaatcccggcgctattgcattaacgcgtatcccggtcccggcaaagtaagtagccagccattttgtgaaatttcccaccgcctcctttgccgcagcataggcagggatcttagtcagcggaagaaatgtattcacggaagcaatattgataatgctgcatgcctccccgcccagcatgtccctggcaaattcctgcgttgtcagaaacgtacctgtgaaattcagatcgaagacaaacttccagctctctttatcaatatcgaaaaaggttttttcacggccaagctgagaagaatcaaaaaactctccggccgttgtggccctcggattatttcctcccgccccgtttaccagaatccggcaccgtccataggtcctggctacaagctcatgcgcctcttttaaactctccgcagacaacacatcgcagccgactgccagcgcagtgccgccggcagcggtaatttcctccgccaccttctttgccgccgtctcattaatgtccagcaccgccacattggcgccggcctcagccagcactttggccatgcagccgcagataacgcctccggctcccgtgatgacggccgtctttcctgccagagaaacatttaacgtaagtttcatcccttattcctcctcatataacttccgtatcagattagaagtcactattcacagccccgccaaaatgcgcgcttctgtgaacagtaacgattagaacagcagtctcggcagcagcagagagatctgcggaacaaaaatcagcagtaaaatgacgatacagatgattccaagatacggcgccagataggtaagcgcctccttcatcttcgcctttgcaattcccattgtaatgaacagcacgcctccgaccggcggagttactccagcatagacaagagtaatgaccataatcagggcaaattgaatcggatcaatgccgtactgggccgccaccggcatcagaatcggcgcacagatgatggtcgccgacagagtctcaataaacattccgacaaagagcaggaacagaaccagcagcatcatgataacgtatttgttgtccgttaaaccggtgaggaaagtgataatcattttcgggaatttctcataagccacaagccagctgaaaatcgaggctccggcaacaatcagcagcgccatacccgtcatggaagccgccttcaggaaaatcctcggcagttcccggtaggtaaattctttgtagacaaacattccgatcaccagggcatagattacagcaattgcccctgactccgtaggagtaaaaataccggagacgattccgccgatgatgataaggggcatgataatcgccagaatcccgtcttttattgccgtcagcctctcccggtagggaacccgttcatccccctttattcccaggcgcctggcataaaaataagtgacgaccgcaacgccgagtccgatgatgagaccaggaataacaccggccataaagcattcgccgattgacaggccggtcagggagcagtagataatcatggtaaggctgggcgggataatcgggccgagagacccggcacatgcctggataaccgccgcaagccccctcggataaccgtttttcagcatggacggaatcagcatggaacccacggccgccgtatcggctgccgccgaaccggatacgcccgcgaagagaacgctggttccgatatccaccattccaatgccgcctgtaatatgccccacaaacgcctttgcaatgttaaccaggcgtttggagatgcccccggcctccatcagctcgccggaaagcataaaaaaggggattgccatcaggctgaaggagttgatggaagaaaacagcttctgcgctaccagcatcgaagagattttatcatccataaagatagcaactaccgaaccgaggccgagcgaaaatgcgatgggcacacccagcattaaaaatacaaaaaacaatataaatgccgtaactaacatacacactcctcctcgcctttttcatcctgcgttccattcaaatgaaccagataataactgatttgttcaaaaaacatcagtactccgcctatcggtatagccgcgcacacagcggccatgggccagtgcatgatgggcgaactttccgccatctgggtctggcagactaaaacgccgaggtaagtcatacagattaggaaaactgccgatgccgcacagacaaccgtaaacatcaccttccaggtttttcccttacatgcctccagcagtaaatcaaagcatacatttctgccttcccggatcgtgatggagcctcccagatagaccagccagacaaatgcaaacctggccagctcgtcggcccaccggatcgaagatccggcgacataacgggccactacctgggcaaatacgacagccactaccaccataaacaggaatgttacaataatattcgtaatttttcgcgtcacatccagaattttattcagcaccgttgcgctccccctttaccgttgtttactttaagctttgaatcttatcgaaaacttcctgaaggttgttgtctgtgataaaattctgaagatatgatgcggtcgattctttaaacggagccagatccacctccgtaatctgcacgccctcttcctccagcttcttcatagaatcctcaaacagcgtggacgtatattccagaaatgcgtcctgggccagtacggaagcctcatcgatcacctgcttctgggcatccgacaggccgtcataaaccttctggctcattgaatacgcggtgaaagtaaatacatgctttgtctgtacatagttctgggctacctcatagaacttctgcaggtaaacgtattccggatggccttccagcccgtcggccacgccggtctgaacggcagtataagcttcaccggacggaattacggtcggattggcgccaaatgcttcaaaagcggcgatagtatgaggagcctccggtgtacgcatgatcagccctttaaagccgtcgaagctgttgatatccttatttttcaccagtgaacttctgaaatacagcggctgtatgcttaacacatggaaaccgcctttttctgccatcttaccgcggataaatgaaagtacatcctcatctctcaccatcttgattgcctgttctctggaatcaaccagatacggcatatcaaacaaagccccggacggatcataattggcgaacagcgcagtatcggaaagggcgatatcaagcgttccctgggataaagcggacagcgcgtcagcctggccgaacagctggccgttggcataaatgtccaccgtcatcttcccgccggacagcttattaaccgcttccgcaaatgcctctgcgtatacgtggttggaatcgtcctccgaacagtgatgggacaaggtcagtgtaagctcctccactccatccacaacagcagcatcagccgatacctgaccggaatctgtctctgcttcctgccctgcactcttcgtgccttccgttcctcccgcagagccggttccgcctccgcatgcagtcagtgaaactgccatagccgccgccatcaataatccccatacttttttcgtatttctcatcttcatcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccgcttcgaattaccgaaaatcctatatcggaatggaaaagaccgatcccacggatgcatatctcatcgcggacttcggcagggtaggccgcacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttatattcatgctgaatttgattcactgttgtcaggctctggctaccatctcgccgtactcatccttgcactgtctgataaatgtgtaaagcgcttcggcgcctggcatatcagcgctgcaggcgtggctggccaccagcatggcagcttcggcgctgcccatctccaggcagtcaagaagctccttcccctccagcagcccgtataaaaatgccgccgcatagccgtctcctccgccaaatccctttagcgccttgaccgggaacggtttgatagaaaagctgtttccatcataggcataggcggtggaaccctccctgccgtgttttatcacgacaatccttgccccctttgcgcaccatgctttcgcagtctccacatcggtcctccccggcgcaatcaggttttccgtcaaatcatattcctcacgtgagccaaggataatgtctgcctgagatgcgactgccgaataatagattgcaatttcatcatgattcttccaggtgtaggccctgtaatcaatgtcaaaaataaccggtacctggtttttctttgcaagggacactgcctttaacgccgcttccctggaaggagaggctgccagcgccgtgcctgatatcaaaagcgcttttgcactctttatgtactcctcatcgatgtcctccacactgagctgcagatcggcaatactgccccggtacattaaaatactgctctccgtcgggctgagtatctcagtaaatgtcagtcccagcttctctccgttttggcatcttgaaatatgggagatatctatcccttcattctcaaaataacgctccacaaatgtgccgaactggtcgtctgatacctttgcaaaaaatcctatttttttcccgagtctcgccattccaaccgcaatattagcgggagaaccacccacatattttttaaaggtctcgctctcatacagcggcttgttgtagtccagagggttaaaatcaatcgcaaccctccccagaaggattaaatcatacggtttatcctcatcaaatgttatgtatttcatttcttcttcctcctgtctatcggtatcctgcaaatacccgttgctgcggcgctgcctcacggttattgaataccttaatgcatttcttcacattttcgcagacataacgcaccatctgctcattcagctcaaaataattatgttctttgctttcagccaggtagtcggcggctccttttgtaagggcgtcaaagtttgccgtggcgatattgattttgcgtattccgcagcaaatcgcctcccggaactgttcatccgtgattcccgtccctccgtgcagcaccagcggaacagaaaccctgcctgcgatattacggagtacgtcaaaattcagattgggaacccctttataatgcccgtgggcattcccgattgcaatcgccagggcatccatccccgcctccctcgaaaatctctctgcttccttcacatccgtatacagaacctggtgatctccgctgccctcatttccgcctactacccccagttctgcttcgaccgtggcgccgtaaggctttgccatctctgcaatctgtctggtaagacgaatattttcctccagcgtttcatcggagccgtcaaacataacggatgtgaagccatattccagagtcctttttatcatttcccgtgactttccatgatccagatgtacggctaccctaactccggctgttctggccgcctcaaccatcataggcgcgatatattccaccggggaataccccatcctcttctctgcaatctgcaggataatcggtgtatccatctcttccgccgccctgattgcgcccatcacgctctccatattggcaacattaaaacctccgactgcccgcccgtgcttatctgcatctgccagcagttctttcattgtgcatatcacaacacttcctccttctgctcccttatagcttttatactccctccttatacgctttacacctcatcattttactttttggtcatttatgatgtgttgttgatttgtttattgttattttatgattgtatgttagcatattatatactttcggtcaatagcagtttacattttcattaattatgcagatttttataccattttattgtgcaaaatgcacagcccttgtccggtacgctttcgcacatcgcagcgcaattctccgcatagctgtttttatttaacaggagaacttttctgtaaaatgaaaaaacagattctccaaggcatcttaccgaatttgattaaatccggaacctgcctggaaaatctgttcttctggagcgtgtttgaaaattgctttccgtcagatgtacaccacactttgtgggagatttggcccgtatgagcgcggcctagcgggctgcgctcatacgggccaaatatgtataaagccggcatgtgtttcaggcccaaagacttctgtaaatattcttcaggtcctccgaatcaagctgtttgcgtgtattggacggacttccgctgagcattgcatcctccgccatcttgtctatggaaccgaaatagcgctccctgtcaatcccatattcctccagtgtcggtatctccaatatatggcataattcttccaccgcatgtaaaaatgcccgggccgcatcctcgtccgatgcatcttcatccgcggctccaatcgcacgccccaggtcgccaaaccgtccatacgcaccgtccagcacaaaagtaaaacactccttaatcagcatggcgttggaaataccatgcggtacatggaacaatgcgccgattggcctgctcattccatgcaccaccgtcacggatgcattattaaacgcaacgcctgcctccagagccgccgccgccatctgaactctggcttccacattctgtccgtcgcagaaggcagccggcagataccggaaaatcctttttaccgcagaaatcgcaaacacgtctgagagcaggccggctttttttgaggtataggcttccgccgcatgcgtcagggcgtccagtcccgtggctgccgtgatcttcggcggagccgtcatcgtaaaccgtggatccacgactgccaccgacggcatgatatcagctccttttagcagcatcttgacgtcatgttccgtatccgtgatgatggtaaactgggtagcttccgaaccggttccggccgtagtagggatcgcgaccatgggagcggtatcggctttaatctcttttcccatcatatctgtgatttttccgcccaaaaccgccaaagctgcaattgctttcatcgtatccagcgcgcttccgccccccaacgcaattaaaaagtcgcagcccgctgttttgtaaagccctgttccggcctccaccatatgatccgtcggttcgccaaagacgccgtcatagacggtatactgaagtccctcccgttccagaacctcctccagaatttttacatttcccagctccgccatcacgcggtcggtcacaatcagggccttcgtccctaattccttaagaagccctgccgcctcatccaaagcacgttctcccattattaccttcccgggcataataaattgaatagccattaccttctcctccttttccttcatcttagttatcagcttgatttgattggttttcttttttgtttttggttccttcttgacattttagtttaattttccttgtatattaactatatattatcattaatatgtatgatgtcaatagttcttgatggaattttgaaactttattgtggatttatataaattttcttgttttttgtttgtattctgctataattaattcaagaaaataaggagctgctaattatgagaattgaacgaataaatgatatggaacgatatattatagaaaatggctctgtcaccagcgacaagctttgcgaggtattccgcatatcaaagaacacgctgctgagggatttgaatattctggctgagaaaggcaccgtaaagaaggtttacggaggcgtcaccgccctgcagcagccgttttccgtgaaagagcttctcccctttaatgacagaaccacgacaaatatagatttaaaaagcaaaattgccaggcaggcggctcttcacgtacagcccggggataccatttttgtagataccggcacctctaccctgagtatcataaactatatagcgcagatacagggcctgaccgttattacaaacagtgtccagttcatgtaccgggctctcagcttccccaacataaatgtgattgcgcttccgggtattttaaaccataagactgcatccctcgtaggcgtcccctgcatcaacagtctcagcgtctataatatcagcaaggcctttatggcctgcaccgccgcctccctccagagcggggtgacgaatgcaacctcagaagaatatgaggtaaaaaaagtggtgatggctcagagccgcgagcatattctgctgattgaccatacaaaatttaaccagacctccctgatgacttattctcagcttaaagatttcgatctcatcattaccgacgaactgccgggaagtgattatatagaacattttaagacacataaagttattttggagattgcaaaataagatacatgatggcatagcgaaatacattacgaaagatttatcttagaatacaggaggtataagaatgtcaaaccgggatttaaaacgcattgctctgttactgccaaacacagataccattctggaaacggatctgcaaatttctcttccttccaatattattatccatactgccagaatgcagttggatgaggtcggcaaggaggcggaaaagcggatggtggatgaagaactgcccagggcagtctccgccttgaaacatatcacaaactttgacggcgctgtctttggctgcacttcagcctcggccgtgtacggtgaggaaggcctgagccgtatcagccgcgagctggaagacggactggattgtcccgctaccaatgcattctccgctgtcctatctgaaataaggtattttaaagcgaggcgcataggccttctgactccctacacatccgaggtgaataaattttttaccgaaaccttagacaggttcggcatctcctgcggagcctgccacggcctgggaatctccgatgacacccggattgcccgtgtagaaccacaggagatcatggaggctgctaagcagctggaacacgaactgaaaaaacaggatctccttttactctcctgcacgaatctccgtgctgccgagatccgaaatgccattggaaaaatgcttgagcttcctgttatcaccagcaatcaggctattattaactggattttatccgcggtataacgataacctgcatgctccgcgcacaggtcactgccatcagtcaaaaaggcggaaccaaaatcgatggttccgccttttcatatccggttatcagccccgtttcccctcctgcactccttataatgcaaacagtctcgtcgccacagtaaagtaaatcgctatcgaacatgtatccaccagcgtggtaataatcggagcggccatgatcgccggatccaggttcaccttctttgccagcagcggcagcatacagccgataatctttgagattacaaccgtgccaatcagggaaatgctgacgatcaccgccagtttcatattccggtacatcagtaaaatcctcaccccgttggccgccgccagaatcacccccacaatcagtgagattctgaattccttataaaccaccctgaatagatccttgaaatggatttcatccagcgcgatccccctgatgacaagcgttgcgctctgggagccgcaatttccgccggtatccatcagcatcgggataaacgccacaagaagcggcacaacggaaattgcatcctcataccgcgtcaggagggtccccgtcagcgttgcggaaagcatcagcaccagcagccagacgatcctgttcttggcgtgctggatcaccgaggtatcaaagtaggacttctcacttggattcatggcagccatcttcgtaatatcctccgtagcctcatccacagcgacatcccaggcgtcgtctaccgtcacgatgcccaccatccgctcttccatatccagaaccggtatggcgagaagatcgtatttggaaaacagtctggcaacctcctcctggtccgtatgggtgtaaacagagataatatccgtctccatcagctcctccatcgtcctgtcgtcatccattgtcatcaggtcttttgccgacacaattcccgccagtttcctgttatcaagcacatagcaggtgtaaatcgtctctttatgaattcccgttttcttaatatgtgccagggcctgggctaccgtattgtccttcctcagatccacatattcggttgtcattatgcttccggcgctgtcctgcggatagtttaaaaggatattaatctgcgcccttttttcaccgtctacggtctccagaatctgagttaccagattggccggaagttcttccagcaaatctaccgtatcgtccatatataaatcgtccaggagctcttttaattcctgatccgtaaacatttgtaccagatgtgactgcatggcgttattcatatttgaaaacacatccgccgctttctctttgggaatcaggcggaaagccgtcgccatctccctgtcgtcaagctcctccagcagggacgcaatgtccacggtgttcatcacatccagaatactgcggactgccttgtattccctctttaccatcagttccataaaaatatctctgttcattgtccagtcctctctttcttttattccgtttttctgtccggttttgtaaccggtaattacacgagtgacaactgcccccggcatccatcgcgtctcacctgcctttcatattccatattttcctgtcttctccggtacggcctcctgcaaaaaaatccgctgctatacgaagcagcggatttcctctatctgaaaaataccatcccggttctaccgatctaccggagaaccagaactgcaacgtacaagctttagtatcacagggcgatagaattgcattaggttatgcctttacgacatctcctgctaaccagcgcgttgtgtctccacaaatttgcggcagcaatcttaggaatcatccaaatccctgtggtaacctcacctaccgaagtttccaactattctgttttgactgactaaggcccctgttatggattggctgtgaaaatctgccgtccaacgccttaagtctgccatattatataactcctgctcccgtctgtcaacaccgggaggaaaatttactcaattttttcgtatatttcacagcccttattgcctttcgttgccggtaagaaggcctttcctgctcctctctatctgctatgctccggcagcatccgcccgatcccgataccaatagccgcaggaattaaccatccaagtcccagtccataccccggcagaagcgagaccgccccggtaatcaccggaattacaatccgtgtctgttccagagaataaatcacactgacaatgccggtcagtaaaatcgccgcaggatacatctttcttcccgctccctctcccctgtggataaaagacaaagcaatcaatacgatggcaaccggataaatcgcattcagcaccggtacggaaaaagccagaatccggctgagcccggcattggcaatcacaacacttgtcacggcgaataagacaacccaggcccggtacccaatcccgggaaccagagttgaaaaatatttactgcagcagctgagaaggccgatacatgtgttcagacaagcgataaagaaaatcacgccgagcagtaaagctcctgcattcccgtaaaaccggcctgccgcaaatgtaagaatcctcgccccgttatccagtgacgccgcctccgcctgtacctgtccgcctacgtaagccagcgccatatagatgagcgccagcaggagccccgctatcatcccgctgtgaatcgtagtccgtaccacctgactgtcttctctgactcccatggctcttatattcagcgcaattacaatgccgaaattcagagccgcaatcgtatccattgtctggtaaccttccaggaaaccggtgacggcggcggctctctgataagctcccgccggctcccccgaaatcgtctgatgataaaaaacactgccggcaaacatgacaaatattaatatcaaaagggccggacagagtatcttaccgagacgctccgtcagcttgtccgggttaaatgccataaccatggcaatggtaaaaaatacaacggaatacagaagctgccccgccgcttttccgccttcccccacaaggggcagaagcgtcatttcgaaggaagtgcctgctgtcctgggaatcgcgagaaacggcccgatcgacaggtaaatgagaatggtaaaaagctgtgcaaaggccgggtgcacacggcctgccagtttttccaggccgccggagcgcgcaaccgcaatcacgcccagaaccggaagccccactgcgctgattaagaatccggcagcggccggtataatggatgtccctgcctgtactgccagaaaaggcggaaatatcaggttacccgccccaaaaaacatggaaaaaagtgtcaatcccacgattaacaccttttttcccgataaacgttcacttctgtccatagctgtccttctcccgtattataatctctcgtcatatcagacataaagacagtttataccgaaatcataaatttgacaaggcagcggccggttttatcctattttttacttgtttttttcaccgtctgcgagaccatctgccggctgtggcccggcgtcccggcattaacaattcattaattttttctaaaatcggaaaatcctcttgactcttacgcatcccaacgttatattgttaactaaatctaattatatttagttaactaataacaaatccgaattgcggatcacctttgtattggagaatgatatgaatctgagagacagcctcaaccggctatactataatatgaccatctatgacgtccgttatgtcaaccggtcaatcaccggtaatttatcctacaacagtatcatgtatctggatattattgcatatcaggataactgtaccgtaagttctattgccgaaactctgggaatttcaaaacccgcggttacaaagaaggtaaatgaactgatccggctcggccatgtagtcaaaacgcagagcgggaaggataagcgcgtctactacctgcgtgcaagcgacgagttacaaaagaattctgtggtttatgacaggccctttgaacgcgccctgcgcacaattgaaaaaaaatatagtccggagcagctcgctgtcctcggtgatatcatggatatttacagccaggagataatgaaagaggatggtgaataatggaacacaaaatgttttctactctttcaccgttgaggctcttcttccgctgtgccctgcccagtatggccggcatggctgtttcctccctctacatggtggccgacggcattttcgtcgggaagtttataggctcccatgcgctcgccgcaattaatcttgtaatgccggttatcatgatcagttttgccctctcggatatgattgccgtcggttcctccgtccagatttcaatccgtctggggcaggggaaagaacgggaggcctgcaccgtattcagtttcagcagcctgtttatcgtcgccatctcctgtctcgtaggcctggccggattctttggaggggcgcaggcggtcagactgatgggcgccggggatgacgtcctgaacctggcggttgaatatatgcgggtctatgccgtatttgccccttttatcatgatcttctttgcacttgacaattatctgagggtatgcggcaggactatctacagtatggggatgaatatcttcatcgcactctccaatctgtttttcgactggctgtttatcgtacatttcagaatgggagtttcctccgccgccctggcatcctgtatcagcctgaccctgggaaccggcatcggattgttcccctttttcggtaaaaagcttgtcctgcgttttgtcagtccgcgcatcccatggcatatactgagaaacattattggtaacggcagttcggagttcttctcaaatatttcggcatctgtctccatggttatcatgaatgcggtgctgctgcgactttcgggtgcaatggctgtcgccgctttttccattgtcatgtacattgactcctttgtcagttccatgctctttggtatggtggatgccctgcagccggccatcagctacaactttggtgccgccaagtacacaaggatgttccggctggaaaagatactgatgaccgcgggagccgtcatctccatctcggcaatggctttcatgctgaccggcggacatctgatcattcctttttttatggaaggcgatcaaccggaactgacggccatggcctcacgcgccatgcatcttttctccttctcctatctgtttaactggatcggaacagcagcaggttccttctttaccgcaatgaataaaccggctgtatcactggccgtgtccttcggacagacgatggcctttccgcttgtctcccttgccgttctgcctgcttttctgggcatcgacggggtttggcttacatccctgtctgcggaaattatgaccgcggccctcgcgttatcattcatgatgtcatttcgcaaaatatacggaaaaaacacacaggcgccatcttgacagcataaatatttccgcgtattttctcaagcctgacatttttaatacaaagctccagaatctgtattaaagactttcggctggggcaggagtgcacggattggtgaagaaagacgtcatccagatagccaccggacatccattttccggttcaacaatatctgcttttttacggaaagcttatatctaaataaatatggtcaataatagatatataacagggatgaaaagcatgcggcacggcttttcatcattaatcaatgaaaggagtgttcccgcatgggcattatctgctacttagccggacttttatccggatgtattctgacctgtctggtagccgcaggtaaaaacaaggactgaccggctccccgtcacatctccccccaatttgacgggcggatctcattaatcctgacgaccagtttttgtatcatatcaagctcttcggtgatccggattccctgtggacaatgctccatacacttgcggcatccgatacagttccctgccctttcctccgccttcagcttggaataggcattataaaactgaaaattgtcttttcccaccagatactgattgtatgcggcaaatattttcgggatgttcacctgtttcggacattccctacaataggcgcatccggtgcatggaatcatcttatttttcaggaacatatctactgcctgtccgaccgcacgctcctctctctcatcaaacggcgttacgcccgtaaccgtggcggcattctcgtcgactaccgcttccgactccataccgctcagcacacatagcacacctggtttggaggcggcaaaacggatcgcccatgagccaagggaccgctccggatggacttcttttaaaaacttcgccgatgattccgggagggatgtcagcgcgccgccccggtttggctccatcacaatacacggaatgccgcgggattcaagaatttcatactgtcctttggcgtcctgcatttcccagtccagatagttaagctgaatctgggcaaaatcccatgcatggtccgacacgatcttttcaaggatttccggtgtatcgtggaaggagaagccgagatgccggatcctgccctccgaccggaagcgctttaatgcatcgtatacatgatacttttcacaaatctcatatttataccggtccagggaatgcaccagataaaaatcaaaatactctgtctgacagcgttccagctgttccataaaatatttttccgtgtccgccgcctctttaatcagccagataggcagtttatcagccagataataggagtttctggggtatttcctaagcgcccccgataagacctcctctgaccgtcccccatgataggagtatgccgtatcaaaataggtgatgcctctctcccgggcatgatcaatgagcgcctgtactccctcctccacgatattttcaggctgatcgtctctgacaggaaaacgcattccgccaaaccccagcagggaaaccttctccggaatttccgcaaattttctgtactccattgtccacctctcctttataaatcttgtgagacctgttccattatctttttaaaacaaggcgctcaaagcattcctaatataatattttcagtataacaaagcctgtttaaaatagcaatgatgtgccgcttcacacactccccggattgttgtgagcagtaactttttttctggtcaacctttgaccgattcgctaaaaacggcagataccgcctgtttttccggtaaaccggaggaactcctggttcatgaatttcattagtaatcccccttccccatatgcaaatggatttatccagaaaatggtctattaattccagccgaaatgtttaaattgatatcataatatggtatagttatacaagttaaaacgaagtaaaaccgtgttcaaaaccggctgaaaagtttggatatggcactgtgcgaagtaagccggatacgcgactgcagagcgccgcagcttgatataacagggggggattacagatatgtcagaatatcaggtgacgcttctcgggattccgggtgtgtttaataatggcaggattgtccattttccttatcgcaaagcggaagggattttttattatctctgtgtggagaaaaaggtcaaccgggacgaactaatatccgtcttctggggctccagcgatgaatcctccggacgcaaaaatttaaggcaggctctctttcagatccggcgctgcctggataaagacgccatcctgctgcatgggaaaaattctctggaactgaatcctaaattcggtttcggatcggaatgggatttacccgaagcggattttgctctccggcaggacagatttctcgattttttctatctcaaagactgcccggaatttgaagtctgggtggaaaacaaaagacgtatccagctttccaggtgcctggattatattaaatcagaactggccgagcctttggtctgccgtgatataacgaggctccggcgtctgattggcacgtgggaatattggaaaccatgggatgaggaaatggttctgaccggaatgaaatgctatatgcaggccgagaaatacgattggggaatccagatgtatcatgagtatgtaaaatgcctgcggagggatctggacgaggagccttcccatgcggtggaattgctgttccggaccatgttccaccggaaagaagtttcgcttatccgaaaaacggatcgcaaggatcatttcttcggacggctggcggagcttcaatacattgatgaacggattttctggttcttaaatcatgaaccgtctgcctcagttgtcattgaaggcgaagtgggagtcggtaaaacagctctgatgcagcagatttatgagatgaaccgtgacgcaggcgtccttgagcttgtctcccactgttactgcgcggaagccgactttcccttaaaatcatggcgggatcttttcaaacagcttgaaaatcttcagaatgaagggaaaatccgtctgacggaaagcagcacagcactgattcatctcgtacttacaggaatggcaacggagaatccggacgtggttcacggcggaaacggggaatatttaagttatatggctttggagaacggggtactgaatctgttgaaggagcttgccggccgatggcgaattattttatactttgacagcctccaatggatggatatcgtcagccgccggctattgcagcgtgtcatgatagaactgggcaaccggcaggtttttatgattgcgacctgccgtattgacggcgaacaggatatccgcgggctccttgcagcgctgcgtgagcgggatatcattactactcttcctctttcgtgcttcacggaggcggagacaaccgaaattgctggaaatgcattgcaaggatgcggcgatgccggaatcagcacccgtgagatttttcttcgcacagagggaaacgcgcttgtattgatggatacactgaatatgatccggcaggacggctggaaggaaggacggccgctgccgagaatcgacatgctgattcagttatggctggaaaagcttaccaaagagcagagaaaggtattggacgctctgtcgatttttgtggagcatgcagagctggaggagctggagctgttggtggaaatggatcggatggagctgatcgaagtgctggaacagcttcttctgactcgttttgtcgtggaacagacatgggacgattatattatttataaattccggcaccggttttataaagactatgtttatcagcatctctccatgggaaaaagacggctctggcaccatgccgtcgcgagattttacgaaaatcagaagaatggggaacgatggctggagctgcttccgtttacgatacggcaatatgaatacagcggatatccggaaaaggcagatactctgcgaaacctccaaaataatatatgacacgttttcatttctgatttggatgctaatttgactacagatttcataaaaagaaaatctgtagtctttttttgtatttttataaaagcggcataaatattaacgttcttttaacggcctgagattataatgataaccatgccgctgaaacagagcggctggaggatatataactatgaaaagtatggagggtaaaggagaaaatgaattctgtagaaactcgaatgatggaagcaatcgacaggaacagaaaaaaaatccacaaaaccggaaggaagatttgggagttcagggaagtgggatgggaagaattcaattcttccgcattgttaatggatgagctggaaaaggaagggtttgaggtacaaagagggctggttgggaaacatcccaagtttgaccacaaaattgatatgccgacagcgttcaaagctgtttttaaaggaaaagaaggcggccctgtcattggcatcatgcttgagtatgatgctctgcccaatggccatgcctgcggccataatcttatcgcatccgccggatttgcggctgccctgggattaaaagaagtctttcagacaacgggatcggttattgtgtttggaacccccgcagaagaactggaaggctccaaacattatattctggaaggcggatatatggatgaagtggatcttatgcttaccagccactatggttcggactggggttcggaagttaccggaaaggccatcgtatggccgacccatgataactggctgactttcaaaggcagatcctcccatgcttcatcgtcaccggaaaaagggagaagcgctttagacgcggttattctcaccaccatgggtttggaatttttaagagaacatatgctggaaacaaaccggattcactacatcatctcaaacggaggtacagccgccaattccgttccggatcttgcaactcttaatgtggagctgaggacaaacgattcggccgaactgaatgcattaatgaaacgagttgacaacattatcaaaggcgcagagctgatgacagataccaccgcactctataaatgggacgctccatggtactgcgctacgccggttcccggcttataccggctggctgccaaatacgctccggatcttggcattgatgaatccagattctctttcggcgccctgccgaaggcgtcttcggatttgggctgtgtagcttataaaatccccagtgttgaaatcacattcccgattgtgggagaggatgaaccagcgcctgtcggccatgccgatgaaacggctgcaatcacgggaaatgaatttcctcttgatcagagtatcctggcaggtaagctcatggcgcttacaggttacagaatcggaaccaatccggaagaacttggaaaaatcaaagctgaatttgaaaaaaattataaagaatagcagccagtcgaactagcgcgtgtctgaaaattgctttctgtcagctgtgcgtcacactttgtgggagatttggcccgaatgaaggaggcgtagtgggctacgctgactgaatttgggccaaatatgccgcaaagtggggcgtgcagatgacaggaatgaattttcaaacaggctctaacacggaaagtgtggactgggctgatgaaaggagccgtaatgtcggagaaattaacatcaacaaaagatttgaaaagagtattgggtttttgggatttaatggcgattgctaccggagcaatcataggttccggtatcatgtcattgaccggaattggtatcggccgtacggggcgttcgatatttgtcgcttttattataggcggtttcattacattattagcaagatcaccacagatatttcttaattcggtggcaagattcaggggcggcgactattccatggtaggaacactgctcggacccagatggaccggaacctactccatgatttcactgcttaccagcgttacactgtccatgtacgctctttcatttgcagattatgcaatgccgtttcttccatggatcacaaggaaggccattgcgctcggaatattgaccctgctgtttgcgatcaatgtttttggagttaacgtttttgcaaagtttcaaaccctggcggtagcgctgctgattatatcgctgacaatatttacggtaatcgggcttacccgtctggatccaaactattttgaaaagagcagttggatgaccggagggttccgcggactgtggagagccgctattctcatgagctatacgtgtgacggcgcacagggaatcacatcactgagcgcggaagcaaaaaatcccaccaaagatattcccagggtcatgctgctgtcaaccgtcggcatagctgtcttttatgggctgctgggcgtcgtggccgcaggcgttctccctgttgagcaggttgcaaaccagcctttaactgttgttgccggaaccatcctttccaaaccgctttattatctttttgtcatcggaggtgcctggatggcgctgattacaaccttgaacagctccattgcctcatgtacaaaacctttaatgcaggcatgtaatgacggctggtatccgttatccctcgccagattacatcctaaattcagaacacctatcattttattaggtatctattatgtcatcggttttgtgccgatcgtattggattttgacatcggcgtgattagtgatataaccatcaccgtcggctccattacgaaattcatgatcgttttaagtttattgagattaccgaaggtaatgcccgaggcctggaaaaaatcagatttttatatcagtaatactgctttaaaagccatcggtattctggatttgtgtgtaattatcttctccggatttatgtcttcagttgaactgccgctgccgttactggccgcgaatctggccgttgtagcatttgcatttgtttttggaagagtcagatttaacagcgggaaggtcaatgtggaagtcagctatgagctgcctgattccgaaaaatagcggtctgcaaaatatggaaactgcagcctggtgagagtaaaactttatggggatgtaaaataagtcccttattaggaatcgccagaaccggcatttaacggttctggcgattccttgtttttatccctactttttacccacttcttgattttactcgtaaaaagagggttcacttaataagcctatgagggtaactcttagcttttaagctgctatttcttttcgctgctttttattatgatatttaggtcagtttacaaggaactacacgcagaccacgaaacgggggctgctgacaacaaataaaggctgagtatcaagcaccggggaagtgcgagatattcagcctgttttgttgtctggggtttccaaagggtacccctttggcacacgactttgcttgcaaagtgtagtgtgttatacgctctgtcggcgttgctgcgaaaatgaggttgccgcccggaagggcaagcacatttgaagcagcaggaaaacagggctgtgattgcgtggcgtggagccgcaagcgcaggactggtttcatcagcagacagggcggatatgaaagcccccgtccctcgtcccacacggatagccacacttacgaaaaaacagacggatttttctctcaaaattgaaatgggcgggaagccattttaaggctttcccgccttgattgactattagcaaagacgggcgggactgtcaacggcggcgcataaaatgcgccgttcatcttgaccattgactggctcggctggctttgctatctccacgataaatgggatttgttatctatctgtccaagaatcgaatctcgttgaaatttgtgggtcgtatagagggcaaccaaaatcaagtaaaatatccatgagagcgttcatatcagcctcttgcataccatagcaatcaaaccttacgatttgcgaagttgtaaaaacctgaaatgctccatgtccttctttttcaaaatctttgcctccaccttgtatattccagtcagaaaaagaatcagccacttttttcaaaatctcgtcaatcggaagaacttccaatacttccattacctcgccatcacaacacgctgcctgatatacggttgaatggtcatgtgcggtatcttccttgtacttccaaaaattcaaatccatactcattgtataatcctcctgttaaaaaagtaaattcaattttatcaatttcttatttcctcccccgctgtgggtttggatttttcagcaagtccgacttctgtgcaatctttttcagccacttcttttcttcctcggacagctttttcaaattcagcttgagccgcttacagataaacgccaaagccgcttgctccgggtcgctgtctggactggcagtttcctcggcggtctgcaaaaaatcttccagcgggttgtcctccgggacgctgaaaaaatcgtccttatgtgtttcccgcaggtcaagagctatcttgtttatgtcctgctgtatcacatagcggcaaaagctgtcatcatcaatatgggcggcgataagctgtcttaactgcgggtcagacaagccgggattgtgctgcttcataatggttgcgcttacagcgtccacaatggcgtttgcactctgtacctgttttcccgccacgccgttcacatagatttcaaggtcagccatcagccgggggaaatccgggtgtaccgccagttcacacaagagggaattatccaccaacccgcttttcaagagttcaatcatatcatcactcaaacgcaggtctgcaagatcggcgtttgggtgatttcttgtttgggacagtcccagcagataatcggcggccacgccgtaaaacttcgccagcttgataatggcatagtggctgatgtccttgaagtcctttgcttcataactacccagtgcagacttggagagatttacctgttcttcaagctgctccagcgtcagcccacgctccacacgcaaatctttcaatcgttcttgtatggatagttccatgctctccctccttgtctgctcgataaatgggaactgtgttatcttaatcttcactcaatgttttcaacatgagttcttaaataatcaaaatattttttgccatcatcattaccgtcctcgtcaggctcaaatatctcccttccttcaaacatataggctctaagcaaatattctgtggcgtttttttcgtcccctatttctaaacaacattcacctaatcgaagcataacaaacggatttccatatccctcgccgctcaaattcccccttgctttgtcaaagcattcgtgtgctttttcgtattgtttcttttgaaaataaatatcgccaatggcagctaaaaaccatatggtttcactgtaaaattgctgtggctctgggattaggctaagagcttctttccatgcttgtatagcttcctcatattgttcttcttcctcaaactgattgcctttttgggctaattcatctaatttagtttttatttgtggtgttagttcatcaatagccacttcttcatttttcttctttgaaaacagtcccataatatacctccgtgaaatttcgatttgccattctatttcttctattctaccacaattccaagagcgtggaaatagagagttttccgggctgatttccgaccttatggatatacggggcgggcggtcttttaggtgtagacttaaggtagttcatcgatgagctgcaccttgaaaacagaatgaccgtccgaaaaggaataccccggcaggggaagcaccgcaacgagccacttcgggacaaaatgtcccgaagtccggggagcgtgccaacgccggaaatcctttcggggagaacggctaaggaaaaatggagggaacacatgagagagaacccatataaacgactgccgcccatagagcgcaggcaggacggttccctttaccgcatgacaccggcacagaggaaacaggcaaacgccctgatccgccgggagtgctgcaactatgaggacgggaactgtatgctccttgacgatggggacacctgcgcctgcccgcagacggcttctttctcggtctgctgtaagtggttccgctggtcggtcttgccgcaaatcggaacgctggaagcagagattttccgggataaggacttgaaacgctgtgcggtctgcggcggtgtgttcgtccctaaatccaaccgggcgaaatactgtcccggctgtgccgccagagttcacaggcggcagaaaacagaaagtgaacggaaaaggaggtcttgtgtggacagttaggggctgaaaagtccttgatttacaaggctttgcaagcacagaacagggacaggcaatagaaactaccgtctgccctagaaaacggggttctaaccgtccacaaaatacgatatgacaaacaccatttatatccatcagccggaaaaggcggtcagctttacccggcttcccaattttctttttgaagcccccacattcacgccactgtccaacgaagcaaaggtattgtatgcctttatcctacgccggacagacctgtcccggaaaaacggctgggcggacgaatatgggcgcatttacctctactatcccatcaatgaggtagtggagctgctccactgcgggcggcagaaggcggtcaacaccctgcgggagttgcaatacgccggactggtagagattcagaagcagggctgtggaaaacccaaccgcatttacccaaaatcctacgaagcggttctaaacaccgacttcaataaatcccgttccggtacgccggaggactgaaaaccgcactccacaagtacgataatcaatcctcttgaagtacggaaaccggacggtatatagaaatacagagataaaaacgattttatttatatcttatccattcctatccgatccgagatattttctgcgggattttcctgtggaaaagtcccggaaaggaacggaatggggaaaggagtttcatggcacaacacgcaattttgcgatttgaaaaacacaagggcaatccggcaagaccgctggaagcccatcacgaacggcaaaaggaacagtacgccagcaatcccgacattgacaccagccggagcaagtacaacttccatatcgtcaagccggagagccactattaccattttattcagagccgcattgaacaagccggatgccgcacccgcaaggatagcacacgctttgtcgatacgctgataaccgccagcccggagtttttcaagaagaagtccccaaaggagatacaggcgtttttccagagggcggcggagtttctaatcgggcgggtaggccgggaaaatatcgtgtcggctgtggtacacatggacgagaaaacaccccacctgcatttggtctttgtcccgctgacagaggacaaccgcctgtgtgcaaaggagattattgggaacagagccaacctcacaaaatggcaggacgattttcacgcctatatggtggagaaatatcccgacttggagcgtggggaaagcgccagcaaaacgggcaggaagcatatccccacccgtctgttcaagcaggcggtcaatctctccaaacaggcaagagccattgaagccacgctggacggtattaccccgttcaacgccggaaagaagaaagaggaagccctctccctgctgaaaaagtggtttccgcagatggagaatttctccggtcagctcaaaaaatacaaggtcacaataaacgaccttttagcagaaaatgaacagttagaagccagagcaaaagccagtgaaaaaggcaagatgaaagatacgatggaacgggcaaagctggaaagcgagctgaaagacattcagcggctggtagaccgtatcccgccggaggtgctggcagaactgaaacgacagcagcggcacacaaaggaaaggtgattgatgacagaaaacatttcacgccgcagcatggcggcactgcactttgaaaattaaatacggaggtactatggagcatatcagatacaagaaagaaaccgaagtcgtgacttttcagggaaaggaaatcacgctggaaaatctctccccggtgttcacgccggagcaggaagcggcaaaacgccgggagctggaacagcagctttatgaggtgttccgcaagtatgccgacaaacggcagagtgaggaagccggggcataaggttttccgaagccatcattgatttgcggggctgctggcggtataataaaactgtcagcagctccgtttcttttttaagaaaaggagcgacaatatgaacaatcgaatagacgcaatctatgcaagacaatcggtggacaaaaaggacagcatttccattgaaagccagattgaattttgcaaatacgagttgaaaggcggtaactgcaaggaatacacagacaaggggtacagcggcaagaacacagaccgtccgaagtttcaagaactggtgcgggacatcaagcgggggctgattgcaaaagtcgtggtttacaaactcgaccgcatcagccgttccattctggactttgccaacatgatggagctgttccagcagtacaatgtggagtttgtgtcctctacggaaaagtttgatacctccaccccgatggggcgggcgatgctgaatatctgtatcgtgttcgcccagcttgaacgggaaacgatacagaagcgggtaacggacgcttactattcccgcagtcagcggggcttcaagatgggcgggaaagccccttacggcttccatacagagccgattaagatggacggtatcaacacaaagaagctggtggtaaatccagatgaagcggcaaatatccggctgatgtttgagatgtacgcccagcccactacctcctatggggacattacccggtactttgcggaacaggggattttgttccatggcaaagagctgatacgccccacgctggcgcagatgttacgcaatcctgtctatgtgcaggcagaccttgatgtgtacgagtttttcaaaagtcaagggacagtcattgtcaatgacgccgccgattttacaggcatgaacggctgctatctgtatcaggggcgggatgtgaagcccagcaaaaagaacgacttgaaaggccaaatgctggtgctggctccccatgagggcattgtcccctccgaaatctggctgacctgccgcaagaagctgatgaacaacatgaaaatccagtctgcccgaaaagccacccatacatggctggcgggaaaaatcaagtgcgggaactgcgggtatgcccttatgagcattaacaatcctgtgggaaagcaatatctccgctgcacaaaacggctggataacaagagctgtgccgggtgtgggaaaatcatcacttcggaactggaagcggttgtttatcagcagatggtaaagaagctggcaagctacaagacattgacaggcagaaagaaagcggcaaaggcaaacccgaaaatcgccgccctgcaagtggagcttgctcatgtggacggcgagattgaaaagctggtggacagtctaacgggcgcaaacaatgtcctgctctcctatgtgaatgtgaagatagcggaactggacggacgcaagcaggaacttctggcgaggatagcggagctgacggtggaagccattagcccggaacaggtcagccagatttccggctacctcgacacttgggagaatgtatcctttgacgacaagcggcgggtggtggacttgatgattaccaccatagccgctacaagcgacagcttgaatatcacatggaaaatctgacgggtggaacccctcccgtcagatacctaccctgtgtagtcccttgtaaactgtattttataaatgttaaaaccacaagagattaacgttagttcgacaattacatttttctcgcctcttcgaaataatcttttgtaagacctgtcccattttaatattccaaatgttccttctgcctgaatccttcgattcattcgcaaaagagctccatgtattgactcaaggttcgatattacttcttgatgtatggacgtcaattcctcattcatgcgaatggttcggttgcccgatgcctttggactgcattcgcttttatgcgggcagccctcacaggattcgcactcatacagttcttccgttctcccatatttattcttataaacgggacgcctccttttgaagcaaaatctttttccgtttgggcagagcagggttccggattcatctctttgaaagtttgcagcatgatatggattttcacgatattttttatcacttgtctcctttttgaacatcgtaaatttcatgtatttttccatcccatgctcttcacaataaagatagttattgtaggaaccataccctgcatcggcaaccggatactttggataacgtccataagttttatgatacttctccatcagtggaacaaaacattccatgtcggatgcgtatggttttacatccactactgcaatgtattcatcacagaccgctgtctggaggttataggccggaagcaactgatcatttcccatgtaatctctttttaaccgcataaaggtagcgctgtgatccgttttggaataactgttcctttcttctccacagatttctatatggtgagcataggcttttaagcgtttaagatatccctgtaattcctgatactgcttttgataaatgcttttcctatgaccacaaccggaaacaaatgtggactcatccagtccggtaccttttctgtacatttccagaagttctgaaacataatcgatggcatactcttcccgcttctcaagtttcagatttaaatatccaaacacttccctgttcatagcgtcgagaagcatcgaaattttttcaaaaacctttccgcgattctttgtacaggattttttccatacccaggtataacggttcgcatttgcctctattttcgtgccatcgatataggtatgttccagatcaacgtggtctttttgaaaaatataggtattgacatccaaaaaaatctgttccattgaatcagtgagttcctttcggatgaagctgccaaaggtggcaaaggaaggtgccttcatgccatcgagaagatacatgtatcggatatcgtttctacagaatttttcgatatcacgcagagaagaaatcccgttttccatgaaagcaaagagtatcactttgaggagtttgcgttcatcacatcttggacgacctgttttgtatcctttcgctacaaaatatcttgataggtcgatgtgatccatcacttcacagaaagtgtataccggatcagaaatatcaattaatttttcgatttccaatggtaatttcaactgacgtggtgtataattaacattggctttattagttagtcgcataattaattataccaaaaaatcgctgaagtctcacgacctcagcgatttttctttagggctgtttttttacagcccctttttggcacttttgccactcagccgccctcccgtcaaatcatatccaattaaaattttcctttccgccccaatctcaaagtggtatttcacaattccggtacgggttgattctgtcggtcagacctttggcctgaaatttgccaaagtgttaaaatcatcttaaatgaggcggtggacgaataaataatatagatgtgcagttgttgaatagacaaaataatgataaagtaaacatagcgggttgttgtatttgtgtttggtttgttgtggtgattcaacaatgaaacatacgtatttctttaatatacttatccgggagggttacagacagtctggacggtaaggaaagtgaggatactatgagctggatagggattataagttttggatttttcctgtttcttcttgctgtgctgttccttggttttttaacggtggttctcattggattatcgattctgaaaaatgggagcattttctttggtcagacttttatcgtttctggtatcttgatgatgacgattgtttcttatctcgtccttgcgaaatattcaaaaggcgcctactcagttctgagttgttttgaaagttatttttacaccggagtcacttatgagccggcactggaaatacgacaagacaaagatggcgtctatttggcttatcacaaggatgggaatctttataccggattcagaagatcgttctttgacaagctccggttaaatccggtcaaagcaaaagcaaatggatttgaatactattacgagggtcagctgctcgggcatacacaaacgcctgatgaaccactggcggtgtcctattccagtccgtcctcgctgctggaagcagacgatattcaaaacgccggcattgccatcccaattcatcaggattatgaaaaagttcttagggaagaaacacaaacctggggagattatgtagtcttggataccgtttacacagcgttcaatcaaaactataaaatccgatacgcagtttgtgtttgcaatggaaagatcattaaaaaagagatctcctttcacaagaatggaatcatcgcctccataacgccctattatccagaccagttcgatcagtggaataccggaaagggaaattatcttacctttgacagcttaggctatctaatcaaaagggagccctggcacgcagacggaacaattgactatcaaaacagccagaaggaagattggtcgctggaaaactttgtttttacagattcatatgcggatggattatttgaaaatgaatgttgggacatggatttgaggaagaaactcctatccccggacagacctgattttttgaaacattcagaaaagtggcaagatgagaatagaaattttgataatttctatctcatgtttggcggaacgacggattataaaacacctgttggcatagggctttattataacagggactggtatccgctcagcagagaacagggggagatttttgcttcggcccttgctgcgggcaagctcatttcaacagccgatgaagccgtgatcgattatcctaaaaaaaaattcatgtttgtgcttcttttggatggacaagaagtgtgccgttttctcttgaaaaacgataagttatatatggataacggactttatgccgtttccctgattcccaaagatggggaaaatgaggaacagcaattctgcatggagcaggagcgaaaaagactccatcgtatgctggaagaaatcacaggtgaatccagcgaagcgtattacatcgaaggctgtgagccgacaaaatgattatatgaacaacatgcaaaatgtaaaagccacatttgctgcaaaactggaaccgaaatggattgcttatggctcaaaaattgaagatcgactccttagcaatgatattttattgccccgaaaatagattccggggcttaatagtcaattatatcagttcaccagattcaccggattccctgccgcaaacgccgccaggttatcagcacctaaatctaacagtttggcccggctttccttagcagcccaagcgatatgaggtgtaataatacagttcggcgccgaaagaagggggttatccatagaaatcggctcctctgataccacatccagccctgccgcatatacttttccgctgtttaacgcttccgccagatcttcatcaacaacaagagcgcccctggaactgttcagcaggattacgccgtccttcattttcgcaattgtattccggttaatcagaccttttgtatccgggaacagcgggcagtgcagtgcaatgacgtccgacttttcgaatagttcatccctgtcggcaaacctgcaattttccgtctccagttccggctttctgaatccgtcgttataaaggagcttcattcccagcgcagcggcagcagcggctgtctgctgtccaatccgtccaaatccaatgacgcccatcgttttccccgacagttcaatcaaaggataatcccagaagcagaaatcaggctgctgcccccatcttcccgcttttacagcttcatcgtggtgcccaacacggttgcatatctccaacagtagtgcaatggtaaactgagatacggagttagtcccgtacgttgggatattgcatacagggatattcctttccctggctgctttgatatccaccccgtcatatccggtcgataaaactcctatgtagcggatagtggtacaattttcaattacctccctgttaagaggcacactggataccagaacggcctcggcatcccctattcgttcaataatgagctttgtatcctcagcctgcgttctgtcataaatcgtcaagtcgcctagctcctcgtagcggctccagcttaaatctcccgggttcttaatataaccatccaatattacaattttcatatctgttcctttctgcttttccagtgcctatatttgattttcacagtgtagttcttatgtatgtatatgtcaagtaggttgacatataattcacagaacaatcttcactgagattgacagaggtataattgtggaaaagaaaagactaccgcataatacagtagcctgaggttaatctccgtacaaaggtaattaagaatcctttggtgagcagtactcggtggagccaaataatagagctggccgtctatcagttccgctctttccccttccggcaatcacccggacaatcgttcaggaaaaactagaaagagccactcttataccttttccaatcttccgagaactcctttaccaatctattatagttataggcagagtcagaaatcacaaagacaataaagtttaaaacaataggaatgattatacccagatagtaaggtaattcccatttttcgatactaagtagatatttgacataaaatgtacaagtagtagctattcctaaaaaaaacatttcatggttaaccagccaagcaattaaattgtaatgcttacattttccttcttttacagtttccgctcctatttcaaacttcattgacaaaggcgcatattctcttaaaaatgaatttatatgcgcactggctaatctataataagaaattcgtgccgaaaagggaattattaataaaaagggaattaagcatatccaagaacttctggtatccatcgcctctgaaatagcaagtcctaaaacagccaatgttgctgtaaaagaaaatgttaacaaggtatttctcatagaatcaaaaaattctatcctcttcactaatttctcatactctttttctttgatagtattttccatgttaatctcctgctacttcatttagctcatactattttaataataccatatttatcctcagcaagctaccactacagcaaaaagcaaggcacatcaagccctgtcagttcatttttgcttcccggttacagatgccgtttttgtctacatacccccgtctatccaggcatctgtaaacataattccccgtttactatcagaaatcgggttggagtaataccattttccatcaatcaactgccagcctgtcttcataccggtgttgatgtctatgtagaaatatccgcccagagccggggcaaaaaccagcccgctcttagcatatccgtcagcaccaaacacatgatatgccccattgttcagttcccatgtaagacgttcataggtactgccaataccgctgaaacgcaccagaaccgccgtggagcggttttatgccactccatggttcttctgtgtgacaatttagacactaaaataagcctacgaatatgttttggtctgcatactcatagacttattcagatgtcgaaatattaatttgaaattacacatttcccaaattattattttttggcactattttactgtgtttgaaaccaatttcataccaatcctgatccaaatcatgctaaatcatgcccacttatgccaccattccgaacatggataaatcctctaaattcacccactcctcttgatactgtaaacgtttaaaggacttcctactcttcctcttccagcagatacggcgtagtctggtaaacgtagaaattaagccagtttgtatacagcgtattcgacatatttctccagttcagcaccggaggtgaaaacggatcattgtcctcgtagtaattgcacggaacctcagggttcatgccctttttcaaatcgcggtggtattcattattgagcgtcatcctgtcatactccggatgcccctgcataaatatctgttttccatccctgctcatcacgaggaacacaccggcctcctctgatttagcaagaatcaccagttcatcgtgttttctgatgtcttcttccctgacctccgtatgtctggaatgaggacagtaaaaataatcgtccaggctcctcacaaggggcaccttgcggtccagcaccttatgacggtagacgcccgaaagtttctttttcctcgggtatttggggattccataatgataatacaagcctgcctgggctccccagcagatatgtaaagtcgatgtcacatgggttttgctccactccataatcttaataagctcatcccagtaatgaatctcctcatactccatgttctctaccggagcgccggtaataatcataccgtcaaatttcttcttcctgacctcatcaaatgtgatataaaacttattcaaatggctggccgacgtattctttgatacatgggattccagcatcagaaatgtgcagtccacctgaagcggagtgttcgacagcgcgcgcagaagctgcgtctccgtatcctccttcaccggcatcaaattcataatcaaaatttcaagaggacgtatatcctggctcatggccctctcttcgtccatcacaaatatattctcagattccaggattaccttggccggaagatccttctgaattttaattggcatatgcccacctctttcaccaaaaagtcgtgtctagtatcatatcatattttaaacataattgccagtccggttcataaaatagatagagaacaggacaaaaaaggatttgattccatgaatgaacccatttctgaaaagagtgcgcgtcaggttatccagcagtcgggacagttcagtctgccgccccagcccgatatacctgtaagcgcccaatcagtttatccacagaacagacatacaaacagccagcaaaatcaccagcaaagctatccaatgaaccgttccttcaaccggcaggcagccgcgcagcactacagggatgaatctctgcccggagtctggcccgacgcttcctgtgagaaccggaatgcgaggcaggagcccgttattccttcggcccccggatccggcagcaaaaaaacagcaaatgaagcggccggtactggttcagccggatctggaacagccggaattgaaacagtcagagctgaaacggccaggcctgaggcacccagagctgagacagccagggctgcccgcgatgaaacggtcaggtctgaaacggccgggcctgcggacagggaaaattccgctgagaaaacggttatcctgcagaatatccagaccgccgctctgacccgcaacaggcaggaaaaccagtgcccgcctccctgtgccgaatccccggattccaatgcatattcgattgcatatcaggccgctactccatatcctcccatcaaagctgccggacaaaaccgtcagtatggcatggcgatgcttgataacatggccagccaaaattcggaaatgtctgcggtgggactatatttttataataatctgatcacgatgggacacagggagatcagcgatgcgtttcatttcatcggtattgtggaaatgcatcacatgcagatttttgcagagcttgcaatgcaattgggcgaaaatccccgtctctggagccgtcatccgcgaaacggcagatacatatactggagtccggcctgtctgcactatccgcatattcagcccccggcttacgggtgccctgtatcaaaggccagtctccgtatcattctcagccaggcaatagagggggaagaggccgcagtcaaaaagtatatgaaccagaccgcctggattaaagatgtgaatgtatgtgataatctgcgcagaattgccgccgatgaacagatgcatgtggatattttcacccgcctgtaccactccatttaattgacacgataaaaggccatgacaaggccggagaaaaggaacagacaggcagccgttctgcccatttgcttccttttctccggccctataagattatctgttccggacacagatgctcaccggcatgcaaattgataaacgccatataaatcctctgcaatacagacatgggaaaactgctcaagttccgcggcagtggtggctcccgtcagcacagcggcaaaatcaatcttcgcgttttccgctgtctttgcatcgaccgtactgtcaccgacatacagcacatgttccttccccacgccaaaatatccggccgcaataagcagtccctcgggatccggcttctctatttttacatcctcggcgcccacaatgatatcaaccgcagagctgataccgaatttgtccagtatctgatcgattctgtaatgatatttagttgtaacgataccaaccttacatccctgttcccttaagtctgcaaaaaccttcttaacgggctgatacagcttcgtgcctgccgtcatgacctcatctgctttttccctgaaatatccggcaaacaggtgcgcttcccgctcatcttcattttgtgttaatgcggtaaacgtattttttaacgaaagaccgatggtctttttgatcgcttccatctccttctccggatatccaagccgtccaagggcataattaatgctggccgcaataccggccgccgaatcgcccagggtaaaatcaaaatcaaaaacgagcgctttatacatatatttctactccattgtaagatctgccatctcaataaattcctgttccgaaatgatcggaattccaagttccttcgcctttttattttttgatgaagaggacgccgtatcattgttaatcagataatttgttttagccgtcacgctcccggtcaccttaccgcccttctgttcgataatctcctgaatctccttgcggtttttaaagtgttccaccgaaccggtgatgacaaaggaaatgccgtcgaatacgccttccgcctcctcttcttctgccgtctcctcgatagtcagctcatccagaagatgatccactatctcattattcttctcactgctgaaaaagtcgatccaggcatctgccagcacatcaccaattccatcgacagacaccagctcttctttcttggcctttctcatcgctgcaaaatcatttttaaaccggcggcacagcatctttgcattggcaagtccgatgccggagattccaagactgtatacgacacggggcagggttgtttcggaggccttttttacggatgcaatcagattgtcataggacttctgaccgaagccatccatggtcacgatttcctgctcataccgatcgagatggaatatatcggcatattcatggataaagccgacgccgatcatcttctccagcgtcgcctcggaaaggccgccgatattcagtgcgtcacggctggcaaagagcgtaaagctctttatcttctttgcctgacaatccggatttgtgcagtacagagattttacatcgttaatttgtctgatttccgtgtccgccccgcagacggggcagtgttttggtatgtctttcactccgctcttagtcaggttttccgcaatctgggggataatcatattggccttgtaaacggtaatcttatctcccactcccagctccagcgcctccatgatacttaaattgtgaacgctggcccggctgaccgtcgttccctccagctcgaccggctcgaatacggctacggggttgataagaccggtacgtgatgcgctccattcaatataggaaagcgtcgtctcctgtatctcgtccatccatttaaacgcaattgaatccctgggaaactttgccgtcctgcccagcgactggccgtattctatatcgtcatagagcagcaccaggccgtcggagggtatgtcgttgccggagaccgcatctgaaaattcctgcaccttcccgggcagggtatctcttgtaacctctttatagtcaaccacctcaaatccctgggaacacagccattcaaactgtttttttctggaattcccaaaatccacgccgtccgccattaccaggctgaacgcataaaagcggacgttcctccgggccgtgatttcattatttaactggcgtacggaaccgctgcaaaggttccggggatttttatactttgcgtccacatcctcaatctgtgcattgattttttcaaaatctgagtagcggatgactgcctctcccctcaaaatgagctggcctgtaaatccgatgttgagcggcacattggcaaaaactttggcgttatttgtgataacctccccgatttccccgctgcccctcgtcaccgcctttgccagagttcctccctcataggtcagcacaatggtcaggccgtccatcttccaggaaagaagtcccttctgatcgccaagccattcctgcagctcttccacactctttgtcttgttcagggaaagcatcggtttttcgtggcgctcctttggcagggaactcataacctcataaccgacattctgagtcggactgcctgcaaagacaatccccgtttccttttccagttccgccagctcgtcatagagcctgtcatactcgaagttgctcattatctcacggctctcctggtaataggcccgccctgctgccgaaagtgtatctaccagttcccggattcttgctgttttattttcaattgctgaagtctgttctgccataaaatgtgcctcgctttatttgttgatttcggttagataaataatgtcctctgcagttcttcccattccgcgggcgttaactcccggtattgtcctgtttttaaattacccagtttcacattcataatacggacccgtttcaaagttttcacctgatacccgagagcttcgcacatcctccgtatctggcggttcagtccctgggtcagaataatggaaaatgaacgttctcccgtaatctcagcctcacacggtttcgtgcgggtaccaagaatctccacgccgtttcgcatctgtcggataaaagcttccgttaccggccggtccaccgtgacgagatattccttttcatggccgtatctgcccctcaggatccggttcaccagctctccctggttggtcatcaaaagcaggccctccgagtctttgtcaagacggccgaccggataaatgcggaccggatacttgagaaattccacgatattttccgccctgtccttgtccgaggtggtacagacaatgcctctcggcttattaacggcaagaagaaccggccgttctttcccttccaccctttttccgttcactgtaatttcctgtgacgtgaaaactttcatccccatggatgccgtcctgccgtccaccgttactttcccgtcttcaatcaggcggtccgcttcccgccgggagcagatccccgcctcgctcagatatttattcaaacggatcccgttatctgtctttgcattgtcattcatatttttcaaacgctcccccgtccgcggctttccccgccatcctgataaacaggctgttaagctcatcccagccctcttttctgtcatccggcatcgcggcggttttcgccttgaattcatccagtttttctgcaatatatccattcagctcttctatttttcttccggccgccgactccggtgtttttaccttgagctctatcagtctgtccaccgccggcttcatctcttcctccaggaccgaacccataagctccgagaacaggaccggaggcggacagcgccgctcttcaatccatttgcaggcgagaatcggacgaaggacatagaaatattttttatattttacatcctccccctgaagatattcgataaaattctttctggcagttccataatagtggtacatgccggctttgcaggaaaaaaagcgctctgaaacctccttgatttccccccattccggcgtcgtcctgtatacaaccggtgaattggcccactcatacagggacgcattcgatttatggaaatgctgcagcgtcttcgataaatcccagccgttgatatccagcgtctcatccagctcccagttgataaaatcctttttctcatccagtctcagataatactgttctggccttacatatacaaacctgacatcataatcactgtcgggggaggcaaagccccaggccctgctgcccgattcgaccgcatgcaggattttcaccccctccatttcttctatctcgtccagcttcctgtccaccagcgcctgaattgtcccctcaaagtctttatatttcatctctgaccaccttttcattcacttccatgacgaattcctccaccgccctgtaatccggttcgtcggggagcatcgtatgttttgcggcataatcaagacgcttctcatagtctgccagaatctcatagaattcatcccggtaggttccgtcttccctctggtattccccgtttcgcacgctcaacagcaatggaaggtccgctccgcggtatgtattgatttctcccttttccagaatatcgagagccatcataaagaggcgcagcagatgcatcgcgtgcttgttcagatgattgtcatccttcttcctgtttcgttttccaaggtattggtattccttgacaatattgttcatctccgcccacagccctttgtaatccctcagtggataatgggtcagtgaggcatccatgtaaatttccgtatccatatccggccgctccgactgatcgatgtacaggcggatactgccctcctcaaaccttgtatatcgcgatttaaaggtatgcatggccctgtttacggaacctaaaatatggcgttccttctcgctctgaccgtaggaatccctggccagggcgttctggagcctgcgaagctgctgatccgcgtaaccgccgaaggactgaatcgcttttttggaaaggaacatccccctgcgctttataagctctctgcctatgtcattcagatacaggtatttcccctcttcaatccccagaagctcacaggtatttggattgcagctgagcagcaggctgatcatcttgttgaaggcgtaaataaccgtatcggtcttatcatccacatactgctcaaactgtgtcatccctatcagatctgattttctgtttaaagtgattccccggatatcgatgtcactgtccgcattgttggtgccgtaggagtagcttcctcccatcgccagcaggatcacatgccggccaaggcgtttattgttccttataaaatcatattcctccgtatccagcaggtacttgaaatccatgctgcctccttcccggaatctgtcaaaacgggaacaccgttcccgatgtccccgttcacttttcccaacgttctaatcttgttccggctttgatgcaataaacattgcatccccgaagctgaagaaacggtacctctcctttattgcttcctcataggctttcagcacgtgttcgcggcctgccagtgcggaaaccagcatcacaagcgtggattccggcagatggaagttggtaatcagacagtccagaatcttaaaacggtatcccggataaataaagatatcggtccagccgcttcccgctttcaggattccatcctcccctgcggctgattccagggtccggcagcttgtagttcccacgcagatgacacgcccgccttttttcttcgtatcattaattttacgggcctcttcttcctccacaatataaaattcggaatgcatatgatgctccagcacattatctactttcaccgggcgaaaggtgccgaggccgacatggagggtcacatgggcgatctctatccctttttccgcgatcttccccaaaagttcgtttgtgaaatgcagccctgccgtcggggcggctgcggagccctcatgttttgcatatacggtctgataacggtttttatcctgcagctggtgtgtgatatatggcggcagtggcatctgtccaagctcgtccagaatctcctcgaatattcctttgtaggaaaattgaatcagcctgttgccttcctctaccacgtctaccactgtgccttttaaaagaccttccccgaaattgattaccgtaccgatttttgctttttttccaggtttgacaagcgtctcccagatatcattttccctgcgttttaaaagcaggacttctattttcgcatcggtcccctctttgcttccaatcagacgggccggaattacctttgtgtcattgatgaccagacagtccccttttctcagatacgacagaatatcccggaatactttgtgctgtatttcccccgtgtccttattaagcaccagaagacgtgaggaggaacggtcctccagcggatcctgggcgatcagctcctccggtaaatcatagtaaaaatcttttacatccattttattgcctcttctttttctattttatgaaatattcttattgtactctgttttcctgagtttcctgactttcctggttctctcctgctccggtctccaggttgtcttcctcatgcatatagtcagggccctgcttcatatataaaatgcgctcattcagggcagggtccgccgccattgcttcctctatctgctgatccacctgggaaatcagcagtctgacgtcctcatttctggaaagctgctccagatagtctgaaagctccggcgatacctgctgatcataaatcttatacgtgccgtcatctgcgcctaccgcatagacctggacaagacttggggccggagtctcaactcccgcatattttatctcataataaacgtacgccgcgtaggtgttctcttccagtcccggcgttgtataacaggaaatgttctggtagctctctatatactgtttctgtttttcaaattcctggcggtaccgctcctcttcactggtatctccggaagtaaacagatgtaaaaacgtgtccatatcacattcggagattgacaggaagtactgttccattaaccagttaattccgggaaccgtatcctgcgacagaatactgcctccaaagtcatggaaatactctttcgtatccggctctataaccggtatcccggcattttccgggaccgtatccacgccgtgtttcgtggtggcggccggaagctgcgtggtgttatccctgaaccggcccgataccagcactacaatcaccaggatcagagcaatcagagggatgctgagcagcaacacataacggcgcagctcattgtctgagacagattgttttcccctggacgccttattctgctccggcttggcctgcggggcggcctgtccctgccttctggaacgcttttctttatcttccggccggcggacggattccggttcttttgcggaagccttcatttcccccggctccggcacctggctctggcccttcgatatctgactttgttctttcggcgcttttctgctcctcggcttttctttagccggaaccgttttcggcggcgtctcagcttgaatcggtgtttccttcttgttcggctctgtcttctcctttttcctcgaaacagaagccgtccttatccggtcaatttcctctattgttttttctatttcctgaactaccttcccggcatccgcactcttcccggcgtctgcattcttcccggcatcaggcttgttcctctcgtccgtatccctctcgtccgcgctgtttattttcacagactggtcagagttctcaggcttctttggcccgtcgggctgctttctcctgcttcttcccatcccgtatcctcctgtatccgccgcctgcggggcgggaacctatctgcttatctgcttcttggttatctgctttgctccgctccgtttggttgaccgcagcacggagcaatctatccaatctatcacctatccgtccgtttccccggggctttatccgctgtctgagtaaaggccggactgtgtttatcacttgcattgttctgctctattctagcaaaatccataataaaaagcaataaaacttatggaaaagaccttgccaagacaaataaaatatagtagaataatggagatgcgtctgtagctcagtggatagagcgccggcctccggagcctgaggcgtaggttcgattcctatcagacgcattattgttatatattgagaaatgccgtaagaacggggaaatccctgattttacggcattttttttaacaggaaatttttcctgttaaacgataacctgcacgctccgcggaggatcgcaatagggaccggagcaaatttctctgccccgctccctgttatcccggtaaattacgcgcccctgattctgccccgtaatctgcctgcttttcatttactaatgaagctctgtcccaaaaggcatcaaagccaatttcgccagcttaaactgctgcatcccaaacgggatcccgattatggtgacacataaaacaatcccgattgcaagatgttccagcgccagcggcaggcccgacaccacaagccagataatattcaatatgagtgagccggcgcctccgccgtagatcacttccttcccgaagggaaagaagctgagtgatgccagcttaaaacactgcacgcctaccggaatcccgacgatcgtaatgcaccagaggcagcccgtcagacaccagcttaagccgctgatggcgccgccgaaaagaaaccataatatattgcccagacatcccatataaagctctcctttccttctgcccgcctcttccttctccctcactccttaaaacgcttccgccggggaaatcacttcaggttttgcattatatgaaaattttctaaataaccttgctcattgatgtgcctcttttttcttaaacctccccttcacgaacgcagcggcgtaatcccacatcccacggggattctgtattcttgccaccgcatagaacatatccggagtcggaatccttggaagatatacgtaataggaaggaacccattcggtgggactgtacttttccttggccctgtataaatcccggaaaccataacagtcattcagatgatcgtatacgaaccgcagcagcctctccaccatgttggaactgttctcctcaagcccggccagcggcgccactcccaggctgccgtattccacaccctcctggcaaaaaatctgaaatgcctgatagatgattgtttccatcacaccgccgggcgcctcttttccatgtcttgtcacatctgccatatatcctttttttcctaaaaacgggacaaatacaataaaggcagccatcttcccggaagcatccaatgcataaaaataccgcttatccatgggctcatcaagacccaccgaccccagcgtaaatttcagcagggagcttttcttctcctgcagccattcctgtgtaatccgctcaaattcctgttcaattaccggatccctctgttccagcaccctgtattcctgtaccgtaacaccggcttttgcggcgtggttaagattcatgcgcatctttgcgcccttttttccgctcagctcatattcggaaagccggaatctggcttcctcaccgcattttacgcagccaaatccctgtttcctgtattcctccagaaaatggtccgttacgctgagaaagaacagcttatgggcgctcttttggcagaactccttaaattcttctaaaagagcagggaagtcttcatctgcgcatacgggatccccgttcacgatgaccgtctccccaaccgtaccatatgggatcacgccatccctcccggagccgaagtaaagatatttatcatcctccaaagccagataggaacagggattctggctgtacaggctaaggagtgtcctggcatgctggatatctgattttccgcttctgcgtgactggaaccacggtttggccgcataggtgacggccgccaggatgcatccccagctgaaccagaaaattgccatctcatattttgttttgccgtacattccctgcagaccgtctcccattccaaaaatcattccggtaccgctcaccaggctgtcccagagggaacctgcgttatccggggatcccaatttcatataatgatagctaagccccgcattggctgcaatgcctgccagggacaggagcagaaacacggcggccgcctttttcgagcgctttgaggaaggacagcagaaatcctccctgaaacagacaaatatgataagcagaaccaaatcgacggccataatcacaagacgggccggatggcggaactcggaaaagcctcggataaaatttaaaagcagtatgaatatggttatgtaccacgccgccctcctgcgcttcatcagctgcagggatactgcaagaaggacaatggaaaaggccctctgcaccatttttcccatctcaagggaaacgcgtacagccgccgagaccggcagggagggcagaaaacttagaatcagcagagccagcgatgccagcacaataaaaagaatgacaatattttcgagtttgattcgggtgttaatttgagtgttatgattcatggcagtctcttttctgaaaatggattctgataatcggataaaaacattccaaatgttcttatccgaatgcaacttaatccaactataattcctgcccatccgcttgtcaataaaatcccttattcaatcttcaaacacgttacagttcagccttcggctaaaccgtaacaaatgatgcacagaaacggcaaaataacgccgtttcgcgccgcacaactcgggattttcgcaaaaaacaacgaaaacacctcgcggaatacatcatggctgaactgttactcaaacgcactattacatctcgattgccttcttcacatcgagaactgcaatctccactccctctttgagataattacagagtatcagtccggaaccggacacttcctccgggcccatatctttttttgtaagctcccgtatatcttctgacgaatctacaagcagacctgcattttccccctgtacatgcagaatcacaatgcaggtatcatcgtcaaacggcgccgcctcaacattcatcctgagccgtaagtcaattaccgggacggaagctccctcatgaattgtttttccaagcacataagccggcaactccggcgcttttctgattttctgcaccgggatgacatgcacaacgttttttagaggtattccgtaccgctgcttaccgcaccggacaatcaagtatgtagcatttaccgcattttcaaatgaattcattcctgtaccctccgcttttattcgtagaaaacgtatcgttttcccgccagccggactgcccgcggcataccggtccatataggaaaattatacaggaaggctcaggattcatccacattcctgcttaaattgaaaagagttatacaaattattatataaccattgacagactttaacggtaacctgcacgctccgcgcaccgattaccgtcttccatcaaaaaaattaccgctgtcctcattttctttctttttatcgcgaatatgcaaaactctcattctctcccacagcatacctggaagataccgtatatataacaaaaatatgattgccgccaatctgggatctaatttttccatattaaaaacgttcccaattttgcgcggtttattccccgagtcatcatgattggagatttaactgaggtgtggaggacgcgtccgaaacggaccatgtccggcgtggtgagggggatggctgagtcttccgtccccggttggaggttgtcgtgaggggggaatccggccggaatgaattgctgcggggaccgtttgcactctttggagtgcgcaacagtgctaagctcgtgaggaacctcgctaagcaccggcggactcccatgtcccctccgcaattgattccgcctacttccccggggcagattttcgccagggacggaagactcaggcggatgttttcgtggcaccggacatggtccgttccggcggcgtcctcacctgcctaactaaataacattggttcagactaatgctcctcttctttccttctgctgaaataaaccgtactgccaatcagtgcggcaatccccacaacaatcaccgtaatattagaatatgtattcagcacatccagaatcttcccccaagacgcgccggcggcggctccggccgtcaccagaaccgtattccacacaaggctcccggcaaaagtcaggatcaggaacggaaccatcttcatcctggccatgccggccggtatcgatatcagacttctgataatcggtacgcagcggcagaagaaaacagtgcttttacccttgttgtcaaaccagccctccgcgtcgtgtacatcctccgtttcaaaatgaaggcgttttccaacttttccttccagcaaatttttcagaacatccttcggtatcagacggccggcataataaagaatcacggctccgaacaccgagcctgccgtcgatgccgcaataacgccgggaacattcattgccgtataagtagtcataaaaccgccaaatgtcagaatcacctccgaggggatcggaggaaacagattttctaccagaatcagtaaaaatatcccgatgtatccgaatgaattcatcacttccactataaactgctgcatggccgcacctgcataaaacgtgttactataatttatacagcgcttaaataatgtatgactcgggattttttcaaaagactgtgtatgacacgccgcaaagcttttcttaccgttccgtcaaatagtcacaaagacaacagagctggtaggacatggtgaccgcccccggatccagatgcccctgtccttttgaaagcatatagctggcccggccttttctggcttccatctgcctcgtactctctgccccgtcttttgctgcatttttgacacgctcaagtaccgtcctgtcattttcccctgcatccagtgcaagcctgaatgcctccacggccggatacagggaatcgatcatggtcttaaatcccggctccgcttttccgcggctcatcatatcctccaccatggccgagagcgccagacagagcccttttgcatccagtgattccctcccagccacagctttagccgccgccaggtacgcgcctccgtaaagaatgcccgagcttcctccaacccggctcatcatcagcatgccaatctgtttgaacacttcatctattggaagtttccttaatttttccccggccagaatgatcgcctcaaaacccagattaaggtttgcccagtgatccccgtcccctgttgccgcgtccaggccgctgatataatccttgctgtcgcgtattaccgccgccgcccggttcaggtaagccacataatcatccgatgttataatcatctttccgccctcccgtctcagcatttaaaagccggtgtatcggccggcgccgccagaagcgccttcagttcctcatccagcttcaaaagtgtgaccgaacagccggccatctcaagtgatgtcatataatttcccactatggtgcggactgcggtaatgcctttttccctgaggatccgtgtaagctcccggctcattatatacagttccataagcggcgttcctccgagaccgttcaccagcatggccgtctcacttttgctgtagtcaaaatcctccagaatccgggacagaagcgtctttgccgtctctgcggccggtgtcaggtcctcccggcagattcccggttccccgtggatgcccatgccgatttccacctctgtctctcccagggaaaagcccggttttcccaccgccggcaggatacagggcgacatcgccatccccattgaccggagatttacaatcaccttttcggcaatccttttgacctcgtccagattctttcccgactctgcggctgctccggcaattttgtgaaccagcacagtcccggctattccccggcgcccggcagaataggtgctgtccggaaccgcaacgtcgtccttcaccaccacgcattctgtccggatgccctccatctgcgccagctctgccgccatctggaagttcattatatcacccgaataattttttataatcagaaggacaccggctccgccgtccgccgcatgaattccttccagaatccggtcggggcttggcgatgcgaaaacattcccggccaccgctgcatccagcattccttttcccacatagccggcatgtgccggctcatgaccgctgccgcctccactgaccaggcctaccttgcccggtattttttcccttctgctgacaacctcgattccttccccggcatagacaagctccggttctgcctcacacagtccctgcagcatctctgtgactacccggtccggattattaatcagtttcttcatgtcctttggctccccccttcttattctgcattatttctaaaattacacgttccgtctctgtcatgcccggatacgctatcagtccgatattctgcattgttttctccggacatacatccgccacgccatgctccggggagatgcattttcctgacagtgccagttccgtcgatgtcacagccgtatccactgccgccagaaccttcatacagcaggcatgattgcctccggtacagatcattcccacaatggatgccgccatattgttaagtgtcgccagaacctcttcgaaaccgcctcctctcataaacgtcatagcgcaggccattcccgttccggctgcaactgcacatccgcagaaagcagatagtttcccggagtattccttcatatacattgtaatcagatagctcaaaaccgtagcccgcagcaggctttcctcggaatgctgttccacccggtacattgcatacaaaggcatcgtacagatgatcccatgatttccgcttcctgtaatgctcatcgccggcttatcaaggcccagaacccgcgcttcagaggccgctcctgcaaagaaacgggctgtcgctcttaaatcgccggaaacatccgtccccccgttaaaggccagaagacttttagtcagcgtacaccgctcggaggtgagcgctgctttagcaagctccaggttcaccctgtacgcctccctgataaaataaaggtcctcgaccggggtctctttcgcaaacctgaagaactcttccattgtatagtccgtaagcgaacccggccgggccgtttcttccagctcccgggtctttttttccagaagcacccgtccgttttttacaagccggcatatattcgtatgctgtcccctgatctcagcttcacagcagtcatgctccgtccggacacatgcataaataaacaattcagagctgatctgtgagacttctaccttcacctttccatcctcgataaaccgctttgcggcttccacatctgcatctgatatctcctccagcaccagaaggcctttttccttatctcccgccacacagcccaaggcagccgcaaattcattcccaatcttatccgtgccagggattccacaggtaaatgcatttttaaagataccggaattttctctcaccagaagacattctgccggttcctccgtcatagctctggcggccgcacaggccagagctatggcagcaggttccgttaccccaagagccggtttcatgtcattcctgatccattcaagcaatgctttcatcttttccgccgctccttcatggtcttatttcttaaaacacatggtacatttcccgcagcctgatgcaatcgtggcctttaagtccatggacataccaaggctctccgcgatgccgcgatccatctccatacagatgtcacagatatccgccagaaatttttcatcctgctcaagcttttgccaggcgttgaccagcggacaataccccaaatccacctcaaattcttcctccgaaagcttcacaacttctccttcgttgaccttttcaaccccataggtcataaactcgtccgcaaaatccttcagattgtcaattccgttaaacctgcttttcccgaggaataatcctgcctcatgcatggcatccctggcaaactccaggggaagtccctgctcaagtccctccttcacgagaaaataataccatcttccccggttttcataggcatcccgcactgcatccacattatagtcacccacatattttttcggttcattctttatcatcttacttcccccttacttttttacaaaatgaagctcacagacgccgtctcccattccgatcgcgcgctctaacttgaaaccgatatgatcatacaaatcaaatacgccgcggtccacatccatcgcacagtcgcagattaagccgatttccttttcatcctcggtgagctttgtccaggccccgcacatcgggcagtaatggaaatggacaatggcctcttcatccgtcatcgagaccagttccgcatggaattgctttatcgtctgatcattcatgaacgcgcccataaactgggaaatgctgtccgtatcaggataattctttcggtagagattccctaatttgcggatagcgctgcgggcataggcctcctcatccagaccgtaccgcccggctgccttcaccagctggtaataccacatccctctggtctcattcgcctttctgatttccttcgataaggtgtcattgattttcgcattgttttgaatcatattaaacctccgttcatatttatattaacctgtataacccaacaggcgcgggattgccaataccagatccgggcagtaggtgcatattaaaagacataccacaagaacgccaatccatggccagattccttttaccatccgatccaccggcacctttgtggccattgccgtcgtgtaaaggcaggtgccgaccggcggcgtgagaacaccgatggtcaggttaaagcacatcagcaggccgaaatgaacaaaatcatagccgtatgcctgcatgattggcaggaacaccggcaccagaattaaaactgccggtgatgcgtccataaacatcccgaccatcagcaggaaaacctgtatgagcagcatggcaatcagtccgttatcggtcagggaaagcatgaaattacagatgattgtgggtatctgttctatcgccagagcccagcccataacacctgccatcgctgcgataatcagtatcgctccgctcattacggccgaccggattatcatcggaattaaagctttcagtttaatctttttgtagataaagattccgacgagcgccaccaccataataatcagcgacgccgattccgtcgccgtcgccactcccgccgcgatgctgacaaaggttaaaaaaggcgccacaattgaaaaagcggctgatttaagcttactccatacatgcctccagccctgccagtcgtgaatcacccatttgcggcccggattcctcgacaggataaaaatcaccagagccagagccagaccgaccataattccgggcaccacgcctgcctcgaacagataggcaatcggtgtaccgctggaaacaccataaatcacatacaggagccccggcgggataagcggaccgaccaccgatacggaggcaataaaacaggctgcaaagtcatcttcatatccgtcctttctcatttccggataaatggttgaggaaagaagggccgcctccgcattggccatgccgagaattcctccaagaagcagtcccacaatcgtgcagacataggcaattccgcctttcaccctccccacaagcgcccggcagaagtccatcagacgtgtcacgtccccggaaaggcccatcagttccccggccaggataaacatcggaatcgccataaggttataagaattggcggaggaaaacaatttctgcgccaccgccggaaaataattcggtcccatggtaatcagcccggccgcacctaccagccccagtacatatgcaatcggaacacccagaagcagagtgaccacaaacataattatcattatcataccgtcacccctctctaatccagccgcgcatattcatttccgtcacttctgggaataaatatatgcagaaatcccagcacttccgaaaaaagcagcagccacattgtcaccggcaggatccaccagacaaaccgcatcggaatctgcatggcggaactgacctggttctgaataatgttggaaaaatacattttcgttccgtaaaatccgatccagccaaccaagcctgcggaaaaaatccgtgacagaattttggcagccgtatggagcggccctttaaacagggaaataaaaagctcaactttcgccagatgaccggtgttggatgccacgtaggttcccagaaacgtcacatacaccagcataaatgtcgccatctcatcactccatgaaagaggacggttgagaaaataccgcatcaccacggagacaaagatcaggcatacctgaagtgtcaaaactgcgcaaagaaaatatttgaccgcccatatcaggcgatcgttaaaacgatccagcatataaatcactttttttgccatactttctccatttccaaaaatagtaagcagcaagggccggcacagacaggcgggagaagcgccgcactgtcaaagcagcctttccagaacattttacaaacatgatcctgcttagttattcgggattccaagctcttcacgtactttcataacataatcataaattgctttactgtcttcattttcacaatacttgtcaattaccggccggcacgctgccacagcggcatcatgatcgatgacagacacctgaagtcccttttcttcaaatgttttatatgcattttcctgcgcagtttcaaaagtgtcatagcaggcctgacgtcccttttcgaccgcctccgtcagccagtctttttcctcctgcgacagtccgtcccatgttatgccgctgcacacaaacagaggggaagcggtcgcatgaccggatttgacaacgtattttgccgtttcgtaggttcctgaggtaatggtggaacatgccgtatcttcaaaaccgtccacaacgcctgtctgcatggcattatatacctcactgtatcccaaaggcgttgccacaaaccccatagcggtatacatatcaagatgcatctgcgctgtcatggagcggagcttgatactcggggcatcggccagactcttcaactcttttttcaggaagaaatcacgtgatgcattatacaaaaagccaaccggctttacggaagtctcagcgtacaccttatcaaggtatccctttgcaaaatctgagctgaccacagtattttgcagttttgtattgaccacgccggtatcatccacccacatatagggcaaatcaaaggcctccagcacatgcgtaaaattagacagggaggctgcattgaatacggcgcagtctatcgttcccatctgcatactctcgaataccgacacctcgtcccctaactgaccgccagcatagatatccagctggagcctgcctcctgaggcctcgtcaagatatgcattcatggcgatcaacgcctgggtataaccatgtgtctcatcccaggctgtcggcatgctggtttttaacagcttcgcgtccgtactctttttctcattccccccattttctgcctggctctctgtcgtttctccccctgccggctgcttctctgccgtacttgctttctggcaccccgccaatgaagcaagtgtcagcgccccggccactgttaatgctacgaatcttttcatctttcttcctcctttttatttgaaacagacatcttctcagccccatatcacaattcccttctatggagaatgctgcctctttaaatggtatgacgtatgatgttatataataaaaaaaatacactgaaattacacataatttggtaatttcagtgtaacacgacgtcatacctctgtcaataacaaaatcagattaattttgcatctgtttatctcctctgccctgttttttcctgcatcgttttcatatgctccctgcctatctcccgcgctctgtcggcatcaccggcctggagggcatgaaacaaatcaatatgaagattctgagttacggtaagctcaaaggaacggcggtatacattcgtcgtatagttcagtgcaatggcctttttaattgtgggaagcatcctctcaatcactatgtttccggtcatacagtagaccagggagtggaattccatctcacagtctgccagctgatcgatcatgcgctgatcgctctcatccattttcagctcatacatgatctcattcatctttctgagaattgcctccatctcactaagctgtcttttcgtcgcccgttgtgcggccagataacagacctccggctcgattacgcttctcgtttcacagagatccggaatcagcttttcctccggtataaactcaaacccatagggatcatccgcaagccccggtatggcggcaacataagttcccttcccccgctcgatatagaggatgtttttggatatcagtatctttactgcttcccttatcgtagtccggctcacattcaaatcatccatcagctcattctcgttgggaagcttggatcccaatgcaaattcacctgtcataatcttagtttttatcttatccgcgatattctgtgaaagtgtaaatcctctttccatagcctgtaccatccttcgtttccctgtaggaatacggccggttgtgccgcttcctgtcctctatattatatatgctctttcctgcatttggcaatcacttttcctcccttgactctttttaattaaaattggtgcgggtaactatttagttaagcaggcgaggacgccgccggtacggtcagcggacggggtggtggggtgtgtatatgagtctttcgtcccggggaagattgttgtgagttggggctgcgggagaagataaagtctgcggagcacgctcccgctctgtgaaatgcatcgcgctgctaagctcgtaagggacctcgctaatcagcgatggatttcagcggcatccgcagactttatcttcccctccgccccaaggccaggttttcgccgggacgaaagactccgccgggtgtatcggccccgtccactggcctgcggccgctgaatgtctcacgcgttaagtgcggggcggaccttgtcgcggccactcagtgctaccgtgtgcgggaaatacgatatgcctacagtgcgccttgatgaaagaattgcgctagatttgatatctgcctgcggtaacacgtagtggccgcgacagggccctccccatttaaggttagagagaatcagcggccgtaacggaccatgtccggtgtgagaaaacctccgcctgagtcttccgtccccggagaaaacctggaccggggaagtaggcggaatcaattgcggaggggacatgggagtccgccggtgcttagcgaggttcctcacgagcttagcactgctgcgcactccaaagagtgcaaacggtccccgcagcaattcattccggccggattccccctcacaacaacctccaatcagggacggaagactcagccggcccccctcaccacaccgtacatggtccgttccggccgcgtccgaaaaaatttaaaaatattagcactcgcctcttgacagtgctaataatgtatgttatattacatctagaacagatagaaaatcatctgtaatccaataccaacaatcaactttttatataaggaggaatgaactatgttagtaccaagtattttcaatgataattttgtagacaacttttttgacgacatgttccggttccccggattcacctccggcagccgctccgtatccaatgttatgaaaaccgatattcaggatctgggtgagaattaccagcttgacatcgagcttccgggctttgccaaagaagatattcatgcggaactttcaggcggataccttaccattacggcacagaagtcctctgagaacgaggaaaaggatgaggacggcaaatatatccgcagagaacgctacagcggaagctgccgcagaagtttccatatcggtgataacctgaaagaagaagacatacgcgcttcctttgaaaacggcatgctgaagctggtattcccgaaagaggagcagcgcaaagcggttgaagaaaagaaatatattgctattgaataattgaaagaaacaggattcacatcaaaataccgatgtgaatcctgtttaactgtcttgacagaccgatttgaatagtaacaattaatgcccgcattctctgtcgtcgtgcatgccggtcacgatgaattccacccactctgctatatttacggcgtgatcgcccacccgctcgaaatatttcgccgccatcagaagatccaggatttcctgcggctctgtcctgttttcctgaatcaggctcacaagctcttcttttatcctgacaaagagctcatccgcaatgtcgtcgtctccgatcactttcctggccagtatttcatccttttttacaagggcttcgacactgtccgtcaccatattcatgacaacacagcagatatcggatatatggaccttttccagaagcggtttttcggatatataccgggaaagctctgcgatatcggcggcctgatcgcctatcctctccatatcggacacaatcttcagggctgctgagacgaatctgaggtccccggccaccggggtctggcgaagcagcagcccggtacagatgttttcaatctgtctgtcctttttgtcaatctccatctccagtgagcagacctgttccctcaatgtttcatcatccccaatcagcacagctcctgaaaaggcaactgcctgctggcacatacttcccatgtcgaacagttcctcttcaagctccctgagctgcctgtcatattccgcccgcatctgtttaagcctccagcctgattataataacgtgacgctgttcaccgcccccgtatctgaaaattcggtccactcgcacacattaaccgcgtgatcccctatccgctccagatacttagcaagcatcagcagatccaccgccatatccgactgggaagaatctgacttaagcagctccaccacctcgtcttttactttatcaaataaagcgtcgatgatgtcatcccgcagttctatctgttcagcagcctccgtatcgcgttcgataaatgcctgaattgcatcccgcagcatggagcttacattttccaccatggcaggaagatgtttgacgttctcaaaggaacagttatctttcatctgaatcgtcagctccgcaatatcggccgcatggtcgccaatccgttccagatccgtcactaccttgagagccgttgaaatatgtctgaggtcacgggcaaccggctgctgcctgagcatcagtgagagacagcggctctctatcttacgctccatctcatccacattacggtcccccttaatcactgtctttgcaagggagtaatcccttttattcaatgcttcaaagctgtctgcaatcgctttttcaaccatctcactcatttttaccagttcgttatttaactccataagctcatggtcaaacattattctcggcgccatctcatttcctcctaataattacagtaaatacttgtttcaaaatatcttcatcagccgaaacggcccgtgatataatcctctgtcttcttctctttcggatgtgaaaacaagtccgtggtcggggcatactcaatgatttctcccaccaggaagaatgcggtataatccgcaatacgggttgcctgctgcatattatgggtaacgataaccaccgtgtatttctgtttcagttcatccatcaaatcttctatcttcaatgtggaaatcggatccagggccgatgtaggttcatccatcaaaaggatttccggctccactgccagcgccctggcgatgcagagacgctgctgctgccctcccgaaaggcccagagccgactttttcagccggtcactcacctcatcccagagcgccgctccttttaagcttcgctcgacaatatcatcgagctggtttttattcttaatcccgtggattcgcggtccataggcaatattgtcatagatgctcatcggaaatggattgggctgctgaaataccatccccactttttttctgagaagcgtcgtatccaccctcggatcgtaaatatcttccccgtctatcatcacctttccctcgattttcacaccgtctaccagatcgttcattctgttcagcgtttttaaatatgtggattttccgcagccggatggtccgatgaaggcagttattttatttgtataaatatctagattaatatctttaagcgcgtgatttgtaccgtaatgcaggttcaaatccgttgtgacaattttattttccaaagttcccgtagtttccatctcttcctccgtttattgaagccttgtaacatcaaatttcctggtcagatactttgtcagcaggttgatgcccagaacaatgattagaagtaccaccgcaataccgaacgcctggtcatactttgccttctgcatagacagatacaactgaattgtcagtgtgccgctggattcaaacagcttgccgaacagactctttggcagctggaatccgcttcccgccgtaaataaaagcgctgcggactcacccacgatacgtccaatcgacaggatgattcccgtaagaattccaggcgcagcgctgggaagaaggatcgtccttatcatataccatttggtggcgccgatgccgagcgctccgaagcggtagctgtccggcaccgtcttaagcgcctcctgagtgcttctcgtaatcaggggaagaaccatcagagtcaatgtaaatgaaccggtcaatacagaatatcccaacttcagcgtagtgccgaaaaacaccattccgaacaggccgaatatgatggaagggattcctgataaaatctcagttgtaaattcaatcgtccgcaccagcctgcccggctttgcatactcgttcagatatatcgccgagccaatccccacgggagcggcgataatcagtgtgatgacaatgatatacaaagtattgacgatattgcccaggataccgaaggtgccttttctggcgctctggacagtggaaaggaactgccaggaaagctgcggaagccctcttataaacacatatcccataatccccacaagaaggctgattgctgcggccgccgcgagatagataagccctttaagcacctgatccgaggtgcggacttttctgttgtaaatacttaaattactagtcatcttccgcccctcctttctggaacatccgggtaagcaccgtattgataaacatgataaatgcgaacagaaccaggccgacggtgaacagcacttcccggtgaagtccctgggaatacgacatttccgccacaatcgccgtcgtcaggaaacggacggaattaaatggaagcggaaggttaacggaacttcccgacacaaggctgatagccatcgcttctccgattgccctgccgcagccaagaacgattgccgttacaattcctgatttggctgccggaacaagcaccttaaaaatagtctgaatatgggtagctcccagcgccagcgatgcgctttttaaatgcttcggcactgcccttagagccgactcgctgatattaattaccgtcggaagaatcatgactgccagcacaagcactgctgaaatcaggttggcgcctcccgtaaactggtgggtggtggaacctgcaaatattttcagctccagtttatacatcagcgggttcagaatcaaaattcccagaaggccgtagataaccgacggaatgccggccagcagttccacggccggccttacaatcgaagcaaccctgggcggagccacctccgcaaggaagatagcggtcaacacgccaatgggaactccgattagaattgccaggaatgtaccgacaatggatgtgagaattacataaaggatgccgaaggaagccggatccgctgttggcttccatacacttccgaagaggatatcgaggatccccactttaaagagcgccggagtaccgctgataatcatgtataaggtaatcgaaaagactgcaataaccgccagcaggccgcaggccgtaaaaatgacctcagctcctttttctaccgccgttttgttcttatgattacgggctatggaaaagtttttctcgtgcatatgtttctccttctaagtaacggatgagaataaactacggccgctgcaccaagtgtgaagcttcgcctttcaagctttcctgctctcagttgcagcggccggatatttgtaacagttcaggcgtctgagctgttgcggttttttactattttgtagtgataaggcctacggatttgacaagctcatccccctcagcagagtacacataatcaaataatgcttttaccaaatcgttctgtgcactgatttctccgtttgtcgccataacgaacggacggcttaagaaatagtcgcctgtcttaatattttcctcattcgcttccactccgttcagagttaaaagtttgaccgtatcatcaatgacatcgagagatacatagccgatagctcccggcgtggacgctaccttagccataacggctccggtggaatcaagctcattggcatatttacatgcatcctccaatttgaggatttcctcaaaggcgcctcttgtaccggaacctgcctcacggccgattaccacgattggctggtcggatccgcctgcatctttccagtttgtgatggttccgttataaatgttaatcaactgttcttttgtgagatctgccgccgtattggccgggtcggtcactaccgcaatcccgtcaattgccacgatattttcaacagctcccttttctttttcttcatcttttaattttctggaagagtttccgacatcactctgtccgcccagaaccgcctcaacgcctgcggaagaaccggtgaattcggcctgtaccgttacgtccggatatttctccataaatgcctctgccagggcatttgcaaatttttccatggaagtggaaccggccagcgtgatggaaccgctcaaaccggccgctgcctctgccgcctgcgtatcggctgcagactctgcctgtacgtctgccgcgggagcttctgccgtatcggctgccggagcagatgacgccggtgtattggaagatgagctgcatcctgcaaggcccattgttaatactgccgcacctaaaattgcgattgatttctgaattctttttttcataattaccctcttttctccttcaatctttcaattgacttattcaaatcttgttattacagttcgcagtataaggcatttgagaaaaaggggaaatcatatttctgtatagctaatgtaaaaaacgggtaatttttttgcgggaaaatgtaagttaatgttgactttttttctcacttccgatagaatcatacaaagataagggagtagtcagcgcatccgtgtagtttagccaacatactgatagaaatatctggtttaactttaaatgatgagacttatctgcagtttctgctgcagataagtcttttttcgttgttcagaccgtactgcatctgtttttcatgcaaaccgccgtaacagttcagacagcatgggctgttgcaaaccgccaaagtttcgcatgagacagccgctctcttgcatatcaatatacgaacagggggaactcctatgtcattagtagaattatttattcttgcggtggggctttcgatggatgccttcgccgttgccgtctgtaagggtctgtcaatgaagcgcctgaataaaaagcatgcagttatcattggtctgtatttcggaggttttcaggccggaatgccgctcatcggttattttctcggctatcattttaaggaggccatcacttccgtcgatcactggatcgcatttgtcctgctggtcatcatcggaatcaatatgattaaagagtccttcgcctcctgcgaatcggaggagctggatccttccgtggattttaagaccatgaccattctcgccgttgccaccagcattgatgccctggccgtcggcgtcactctggcattcttaagcgttaatattatccctgccgtttcttttatcggcgtcaccacatttattctctcggtggccggcgtcaaagcaggcaatcttttcggaatgaaatataaatccaaagcggagcgtgccggcggtatcatcctgattctgatggcagccaatattttaattgagcatctgttcttttgaccggacgcagacattaacctgtacgctccgcgcacaggtcaccgtcatcaatgtaaaagagagcggaaaaagcaatcaccgggctttttccgctctctttggctttctttttctgtttaatttccgatgtaaaagccaggcccgagaagctcctccgtatcccgcagcagctccgccgcctcatcataattttccgccgtcagcgccattgtaaaataattgatcaggcaaatcggcgcaacatgggaattctggtaagacgcagtccgcacccggcatggcagtatgatttcagcatactccctggccgccacaaacgtggccgacgtaaccaggataacctttacctgcctcttcttcatccattcgagaagatggattgcaagggaggtgaaccgtgggaatgcaaagacgacgcatacgtccccctttttcatgctgaccatctcttccgggtactccatacccgtaaaacgcaggagccggatatctcttcttagcctgccccagcttgcaaaagcgtagtatgccagtgaaaaacccatcctcatgctcataatatacagggaatctgccgactgcatgagagacacggcgcgatccagatcttcctctttcagatccttcatcgtgttttcaatattgcggatatcccgttcaaaagatgtggccagcctgctgctcaccttctggtccggggaaccactctccggctgttccgggatcatatctttatttaatacaatattctgcgcatccttctgaagctccgtaaatccggagtagccaagctgcctggcaaaacggattaccgtcgtggtgctgacccccaccagaccggccagatcttccagcgtacccaccgcaactttatccagattatataaaaaataattcgcaacctctttgtgagatttcgtcagctcatcaaaatgctccgtcactctgttaataaaatctgccatctttacccgctcctttattaacaattctaacattgcatatttaataagtcaaaagcttattctcaatgagctgttaccgtattctcaatggactgtttcatcggtaaatgtaagcttatttgagcttctgtccccgtacgccagcaaaatcacggcgcacaggatacaggcaatcccgaaggcagttcggggcgtcaccggttcactgaacaggactactcctgccgctatgctggtcaggggctcaaatgtactaagcatggaggatttctccggtccgatccgggccgtccccgcctggaatgaaaccgtggcaaccacgctgacgataaaagcgaacagtacggatagaagccacgcctgaggcggcatctcatatacgatctttcccgacagaaccgccccggccaatatgccggctgagcttaccagggacagataaaaactcagcttaaacgtgttcatttctgcaaggccgcttttggagtagtacaggacataaagggcataggtaacgcccgaagcaaaggccagggccactccggccgggctcccggattcccccggagtgtagaagaacaaaatcccaagcaggcacagcgccgcgcagaccgacttttttaccgtgagcctctcccggtaaaagacaacgcagccgagcagcaccagaatcgggtatacaaaatggattgtcgtcgccatcccggacggaatgtaccggtaggactgaaacagcagcagcggcgttcctgcgcagcaaagtgacagaaccagtattttcctgaactctcttcctgtaattttcaggctgattttatatttgtaacggacaatcagatagaggaacgggatactgaggcaaaaccggtgaaagcaaagtgtaagggaattgcctcccatcccatatatctgctttgcaaaaaagggcattgtcccaaacaggacggctgataatattacgagcgaaaaaccttttttcatcctctctctcactctgccggcattctgcgcagctgatagacgtcccctctcctgttttccagagtaaatacctgtctgcgtactctttcaagataatcaagatcgatctccgcagtaatgacacagggctgatccgacgcttttgcaattacattgccccatggatctaccacgagtgacttcgcatatgcctggaatttcggtttgattccatactgtcccggggctatcacgtagcagccgttttcgattgcccttgtgcgcagaatggtttcccagtgatccttacccgtatttaatgtgaaatctgccggtacaaataaaatctccgccccctcaagagccatgagacggtataattctccaaaacgcatatcgtagcagatagaaagcccccaatgtcccacctcattcgtgtcaacggtcacaatctcatttcccggacagatccgttccgattccctgactgccggtccatttttaatttccacgtcaaatgggtgcattttatgatacttcgcttttaactcaccgtccggcccgattaccatcgtgcagttataaggccggctgtctgccggatttttttcatagatgctgccgcagtgaagccagaccccatatttcactgccagctccgacagaaaacaaaatgttttgcctcccggaacatcttccgcatatttcgcgctttcatctccgacataattgacattttcaggcattgcaatcagctttgcgtttttttccgctgcttcctcaataaatctttccagttccttcagattttgatccacgtcattcccggaatccatctgaatgactgcggctgtaaatttcttcataagctttctccttcttaaacgataaccggcacgctccgcgcgcaggtcaccgccttcaattatgctgactaactgttgaactcgctcatcataaaggcggcaatcttatccacgcatttcctgacaatagcctcacctttttccctgcttccaatcgttgcatccccgaggatgccgttcggcgttttgtccctgaattccgtgtatgtaataatatccgggtattttgtatactcctccggcattctgatacactctgtcttcgtaagatccacgtattcaggatgcaggtaaagcataactgaagttccgcattcactggcatgtccgtgggccatccatcccgtattttcacagattcccacggaattcggctgcgtaaatctccaccagtcaatctgggcgcatttgattccggaggaacgctggtattcgcggcagagctgcccgatgatgggcacatttccggcatgcatattaataaacatgaaattcttaaatccccagtgaattaatgattccatcacatcgcgcatcatcagatagtaggtctgcggcataatcttgattgttcccggaaaaccgtacagtgcggctgattcccccacttcaataaacggccctatcatcgcattcgttttttccgccaccatctcgcagattgcctttgacacaatggaatcggaaccaagcggcagctgcggtccgtagacctctatcgccccgcccgggataatcaccgtgtcgcaggataactttctctctgcaaattccgtccagctcatctctttcatccaattcgtatttttcatttttacctctttctaaactttatttatatatgattaaactgcttttttatggtactttttcccgaaaaacattccggctcccaggagtatcagcataagtccccagctccacagatagacaaacatcggctgcgtcataatcagcgcgataaacaccagcgtatactggagctggtacgtatagcccaatgtgctggaggaagtgatattggttgccgcattcgtctgaaaatcaggatccaccacctttaacagaagaagtccggtggcaagtacgccgcagcactggccgaatagccctaccgaagtctcaaaacagtcatccttcggcagtacccactttgacaggacgaagctggcgaaccaggtcactaaagccactgatgctccgaccacgataagcggcaccgcatacgtcgtaaatacgctgatgctggttgtcgccagcgccgccgtaatcatatattccagcgcgcttccggaaatacggaccactgttttcctgtctatcatatcgttcacctttttcgccttctgtgtcagcacgcagaatatggcgctgaatatcagacagcaggcaaacaggggaagattcttgaaaaacggatttatccggatcagtccggtacgcagtatatggccgcaaagaataataaatccgaccagcatcacctgagcccccaatggatcgatcgccgcggaggaagtgacggcattgccgatggacggcctttcattttcaggatagtatcccgtcagcatgctttccggcatttcctcccttttcatttttaccttcgtaatccccttttgggccgcccggtttatttcgaacattccacagataaccccggtcaaaagcccgattgtcgcaaatgtggctccgacctgtgcgcctgacgccatatatcccgcttcatcaaaaatcgtaccgccggcaatcgccatggaatgcccgccgtaaaatcccagtacgggaagaattccaaatccgaacttcaaatccgcgaataccaggccaagaataaatgtaacggtcagtccggcgataatctgcagctgatgaatggtccccgctaaaaaataggtctgcatcgcctcgcccgagaccttttccagtttcagccccaggaaagaacagctgaagacaatggcgcttaaaactcccgcccattggccaatcgatgaggaaaatgaaaaacataccggtgaaacctttcctaaaatctgaggccctaaaagcagccccaatatacctgcaatcagtgaaaccgggatataatatatctgtaaaaatcttatctttcttctgagccatgcccccgccacaagaagaatactaatcatcgaaaagtcaattaaaacatctgtcagtgtcatacctttctcctttactctctgaactttgccggcccccagccggcgtcccctctgtatcttgtatcactgttgtccataatcctctcccttacgtctcctgcgtaacagttcagacggcatgaaccgttaacttccgttaccttccctcacctctctttccctttaaaatgttttgcgcaatacattttgtattatttaatacatttagtataaagcactcctttttacttgtcaattgtgcttcatgccgaaactaaagcctgatttttgtcgataattgctattcaatttttatttccttgttattttcagctatttaaccaactgctttctatatttttaccatatccgcttccagccctcggtaaacggattctgcggatttttccaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcaccgaaaaaaggacatatggaaacctgatatggattccatatgtccttttacgttactgttcacacggttgtgttccgcggggtattttcgtgcgcattaagcacgaaactcccgagttatacgacgcaaaactgcgtttttttgcaatttccgtgcattgcggaacgtgctattgttcgcagcacgccggatattccctactgaccgtttgtatttaatattacctttttaaaattcttctttccccgtttcactacgattccatcgccggagagctgtgccttggtaaatacggccttactgtctttcacggcctcaccgtcaacagccacgccgccctgctctacgtttcttcgcgcctcggaacgtgaaggagccaggccggacttctgcaggatggtgagaatatcaatctcgtctccgttaaaatcttcttccgtcagctccgccgtcggcatatcggcagcatttccgcttgtaaataaagccctggaagcttctttggctttctctgcctccgcttcaccgtgtaccaggtttgtaagctcgaaagcaaggatttcttttgccgtatttaactggcttccctcccacttatccatctcattgatctgttcgatcgggaggaatgtgagcattctcaggcatttcagcacatcggcgtctgcgatatttctccagtactggtagaactcaaagggcgatgtcttgttcggatcaagccatacggctccggactgggtcttgcccattttctttccttccgagtttaacagcagggtaattgtcatggcatgggcatccttgcctaatttgcggcggatcagctccgtacctcccagcatgttactccattggtcgtcccctccaaactgcatattgcagccgtatttctggaacagcatatagaaatcatagctctgcataatcatgtagttgaattccaggaaggttaatcccttttccattctctgcttatagcactctgccgcaagcattctgttgacgctgaaatgcggtcctacctcgcgcagcagctccacataattgagtcccatgagccattccgcattatttaccatcattgccttgccttctgaaaaatcgataaaccggctcatctgctgtttgaaacagtcgcagttgtgctggattgtctccaccgtcatcatctggcgcagatcgtttctgcccgacggatccccaatcataccggtcccgccgcccagcagggcaatcggcttattaccggccatctggaggcgcttcatcagacagagagccataaaatggcctacatggaggctgtcggccgtcgggtcaaagccgatgtaaaatgtggccttgccttcgttaatcatgttcccgatttcttcttcattggtcacctgggcaatcaggcccctggcaacgagttcttcgtaaattttcatgttacttctccttttccttccatgaaattattcatatttccaatcgtttcaaggacgaaaccacagctcaaagcccgttggcacacaggcccggatgaaaaaacagcgaaaacacctcgcggaatacatcatggctgaactgttaccaaaaaagccccgtccttcataaaaaggacggggcgaaatcccgtgttaccacctttattcacaaacagctcgcactgtctgcctcagcaagtacatcaaaaatccgatatactccggcacgataacgtgtgcctgatacgtcacagcctactgggaaccaataacaattccgttgggtgtgcagctccgggatgtattcgtccgcctgccgaaacgcgcgcctctcatcaaccggctgctttctgtgcgtcatacagtaactacttgttcccttcaaagcctttacttaaaaatatttagtttaagtacttgacattataggaagttttgtactgtttgtcaaggcgaaaattttaaataacaggcttatcctatcagattcggcaaaaacgtaacggtttccggtatatatgtaataattagcaggacaatcagcaggaccgccagcatcggaagaagatccctcatctggtcttttaaggatacctccgcaatggtaccggatacaaacaggcataccccgagaggcggcgtacacatgccgatcgtcaggttcaccgtcatgaccaggccgaaatgcagcaggtcgattcccattccctgtacaatcggaagaaacagcggcgtgaagatgaccagcgcgctggtcgtgtcgataaaggttccggccaccagcagcactgcgtttatgacaagcagcatcagatatttatttccaatattctcggtcagtaaagcgctgacctgctgcggtacctgattcaccgtaataatccaggtaaacagggaggcgaaggcaaccacgatcagcacctgaccggtcgattttgcacagtcgataaatacgccccataggcttttaatcttcagctcccggtatacaaagattccgataatcagggagtagacacaggcaatcgctccggactccgtcgccgtaaaaattccgctcatgattccgccgatgataatgacaggcatgattaatgcgagcagggcgtcttttcccgttttcagcacttcgcccgccggcgccttctgttcacgtcccacataatgacgctttttacctacatagtagctgtaaaccatcaggccgaggcccatgataattcccggtataaaaccgccgataaacagctttccgatactcacactggccattgtcccgtaaagaagcagggggatgctggggggaataaccggaccgatggaaccgccgcaggccagaagaggagccgaaaatgtattttcataccccttttccttcataagaggaatcatgataccgccgatggcagctgtcgccgcaatggccgaaccggtgatggcggcaaagaacatgcaggccagaatactgaccatggcaagtccgctggggaaatgtccaatcagggcatccgcaaaatccacgattcgcctcgacatgcctccctggaccatcaaaccgcccgccaggataaaaagcgggatggcaatcagcgaaatactgtcggctcccgtaaacatcctctgggtgatgacggacaggggataaccggccgcagccactccgtaaagggagattaaaccaagggaaaaacaaatcggcactccgactataaataatccgaataacagtataattaatgccatcctatttctccccctttttcaactgaataaattcctttacctgtaccgccagatttccaatcatgtaaaaaatcatgaaggccgccgcgctgggaatgctcatataataccaggacatcggaatcggcagataagacgttgtctgggtcgtacctgtctgtgcgaactgaagtcccatatataacaggaatacgaaaaatccgaccagtacgacatttatgatgatttccaacagctttccaatcaccttcggaagcgaagtcaacagaacgtctacgttcagattggctttttcatggacacaataggccgctccccaaaatacaagatacgtaaagctcagcctgattatatcctggctccacggcaggggcgccttcagaacgtaccggcagaccacctgccagaacgtcactgccagcagaacaatgccgctgaccgccatgacggcctttatcactttatccaccactagattgatcactttcatactcgaacctctctgttaagtctctcacccacgatatgttttctctgctcttttagttcccgctgttcttatactcttcaagcttctgcataacaagctctactaactccgggttaacaagctctttgatttcatccctcagatagaaatctctggtcgcctccttgaagctttcgatatccggttcgctgacctttacgccgctctccttaatctgttccatatactctgcttccatggaatccacggctgccctctgttcctcaaccgcatattgaacagcgctgtcaatccagcccttcacctcgtcagactgcttgttgtaaaaatccaggttcatgataacgctctcggcgccataggtatggccgtccagaaccatgtatttctgcacttcattaaatccggaggaagcgatggagacaatcgggttttcctgtccgtccaccgttccctgctgaagcgccgtatacagctcattaaacggaagagccgttccccttgctttcaggcagtccatcaggctgaaccatacggtagcctcctggacacggatggaaagcccctccatatccgatgcttttacaacttcgcgcacattattggtgaaatggcggaagcccagctccgcaaagccgagatgcttaaagccctgcgcctcaaacagcttttcgaattccggttcaagtacttcgtccagtatgtaataggcctcctgtttattttcaaacagatacggaattgataaaagctgtacatccgacacccaggacgggagcgttccgtctgtcgtcacaattgtcatctccagggttcccagcttcacgccctcggccgcctcacgttcacttcctaatgaagcgttgggataaatcgtgacttttacctgaccgcctgataattcctcaattttttccttaaaatacgttgcggcaattgtggactggtgcttttcattgcctacggtagccaccttgatctcaattgcgtctgcggcttttgccgcctcctttttagtcccgccgtctgccggagcttcactttttttgcctccgcatcccgttaacgcggctgccactgccattgatgccaatactacccgaaataactttctcattttaccgttcctcctcactgactgtaatcaccttgtaatttaatgataactttcttcccaacacctcgtcgtccatctcgcatctgaattcggtcccataacggaacccttccgtcagcggaaccgtaccggaataaatcacagcgtccgtaacattgcccactctttcatccagctccttcagaatcatccccggatccatgatgtctgccagagttccctgctgatagagaatctcctcaccatccaccgtctgataggaatatagcttaatggtctcccagtgttctttgatttcttcgtagtcccacagaattgtcccaatcggtttggcgcaaatctgtttcgcctttggtacgctcattccctctaattcgcgatccgtatggtcactgccaagtcctatgtaaagctttcctccggtcaccaccatcacatattccacttccccgcaggtcttttcccctataaaatgcaggtctttttcctgggtcagcagatacgtgccgcactgaaatatcgtcggaattttcttcggggccggaactccgagctgttcctccagctccctgatatgctccatggttttctccatattccggcctgcatagccgatggcgaatacctgatcataatttatttctttctcctgcgcaccgtctttcgtcattaacagaaatttcatcttactcatcttatccgtttcctttcaaacccctaagtgataaatgccgggacgcctgtccctgtatatgttgatgctctcccggatgccgcgtatcatgtcaagatccagttctgccgccagtatttcctcgctctctcctgctcccgttatcgtctctccccatggatcgattgcagcggaataacctgcgtattttgtttctcccgccattccgcagccgttaactgcaacgacaaagcactggttctctatggctctcacccggttcagcacctgccaatgtcctttccgaagcagcggccactgggcggctacaaacagaacgtccacgccccgaagcgtaagggtccggatcagttccggaaaacggatatcatagcagataaccatcgcgcaggccaccccgtccagttcaaagttgacggtatgatcccccagctcaaagaaatcctgttcgcccatcggcgtaaaaagatgggtcttatcatactctgcaatacagcttccttcacggttaaatatgtacgccgtattatatacgccgtccccctttacgttggctacggaaccagccacaatatgaacccctagttcctttgccagagaaccaatcctcttctttacctgcactccgtcccggtccgacaggatctccaggttctccctggggaagaatcccgtgttccacgtctccggaaggcagatgacatccggcttttcggcggccgcgctccggatcagttcttccgcatgggaaaaattgtattccggatctgcaagccgcacatccatctgaacaatactgactttcatctcgtttacctctcactcctctattttccatatcgtatgtaatatatgatatatggtataccacttagaataagataacacgattgtgcattattgtcaagcctcttccctttttcctgttctttttaggcagtatttacacgatagccagattccggttttccagacggaaaaaaccggtcgttctgtgtgtcagatatggcagaccggtttttaatggtttcggcgggatttcatataattctcgatgttgttgaacgtctccgtcatatgctcttccatcgcgcggacggctgcgccggcatccctgcttttcatggcgtttagtatgttctggtgttcatccatcgtcgtcagcttccgctccttcttctgcagcgcccggattccgaaaaatgaaataatatcattaaaattacttaaaagtccctgcagggtcctgttatggctcagctcataaatcttctggtggaatttgcggtccatttcaataaagtcatactcatcataatggttcagcatatccctctggcagcagactatctcttccagctcttccagatccggagccgccgcattttgcactgcatcttcgactgccagcatctccagcgattttctgatttttaatacttccagtacatattccagatcaaattccctcaccagagcgcctttgtaggtctccaccaccagccatccgtcatgctccagcatctgcattgcctcacggatcggcgtcctgctgatacccatctcctcggacagccttctctccgtcagtacatcccccggcacgtattggcccttcaatattcctctttttatctcattgtacacctgatatttgtacggctgtgctttttgtaccacatctaatctcccaatcttgtattaataaatttatgtatatgcattgttaccactgcatcactcgaagccttttctgcccttcattcctcccgcttctttttgcagtcttttcctccggtacatcatctgatccgccttcatgaacgcgtcctcaatcgtcaggcaggagatgttacggtcgagaaactcccagccggcggcaaaattaaaatgaagcccggtctcctcctcctttttctgcagtagacggcctgcttcccccaggcatttcttcaattctttctcggaaatctcctccgccagaatagaaaattcgtcgcccccgattcggaatatggagacgcgcctgccggtaaatgactgtctcagggcgtccgccgccattttaagaaaaatgtctcccatatgatgtcccctgctgtcattgaccgtcttcagattattcaactctatcatgatacagcaaatccggccctcccgctgttcccgttcatatcggttgagtaaatccacataagccgcccggttccccagtcccgtcagggagtccgtataggcaattttgtaaatctccttctcatgctccaaaatcctgttctgctcggtaatccggcgcgtttttattattgatttgagaaaaatgttatagcatgataagatgacacccgaataaaccaggtatgcaggcccatactccagccgctcaatcatcggtttgggataagcggcaaagaataccagtgaaaaatagatcaggcccattgaaaatgccatcccgttccacccgacgtcaaccagctcaagcagttcgtgatatctctcaaaatgcctgttcccaagctttataaccatcagatagagccccgctgtgactgcaatgctgagcacactgcctgcgtctgatgtcaggatcccgatgtagcggcccgtgaagccaatgattagggccagggaatgcacaaaaaagaacgtgacgcaaaaccggctgtccctgtgctttgagacgccgagaaataagaagaggcccgggactcccacacacagaacagaggctaccgacgaagccatgccgtaaaacccggcggcaagtgcatataccaggaatatagccgtgcatcccccatacataagggtcttataaaacagattctttttccgcagtgaaaatatcctggtacatatggcaagagtaaataaaattacaattacgtcattcagcagtgaaataagcgggttcaagccggtgctcctttcagacaatgcgggcagcaactattttgtcctttgcccatagtataacacgactctttacaggttgtcatttcttttttcccggcgccttatctcctcacacggacgccttgaccgccatcctgcccagttcgcccaatatttcctccgctttttctatcattgccgtgcaatccttgttttttgctctgcgatcctgatagataaaggtggggacttcccctgtcctgaaaacaaacgcccccttgtaccggtcgatcagcccaggaatgcccgttgtgtcaattccggcatttttatacattctcagtgtaatctcctgacggtttatattaacctccgtcacgcctgcctgatgggccatcgctttaatctgcgctatcaggagcagattttccaccggttttggtatatcgccgaaacggtcgatgagttcgtcctgcatatccatgtattcttcctggttttcaatgccggaaatccgcttgtaaatatccagcttctggtattcatttttgatataggatgcaggaatataggcatcgatatcgcagtctaccacagtctcaaagccctcgtcttccttctgccctttaagcgccagaactgcttcgttcagcagcttgcagtagaggtcgtagcccacggcctccatgtggccgtgctgttccgctcccagtatattgcctgcgccgcgaagctccaaatcgcgcatagcaatcttgattccgcttcccagctccgtaaattcccggatagcctgaagtcttttttccgcctcctcccgcagcagcttatcgcggcggtacattaaaaatgcataggaagtcctgttggaacgcccaacgcgcccccttatctggtaaagctgggaaaggcccagccggtcggcatcatgtatgataatcgtattggcattcggtatatcgaggcctgtttctataatagtcgtggacacaagcacatcgatgtccccattgacgaaatccagcatgattctctccagttcatgttcgtgcatctggccgtgggcaaatgtgacatttgcctccggtacgagagccgcgacatgattcgtgatctcatcaatgttattaacccggttatagacatagtacacctgtccgcctctggcaagttcacggtgaatggcttccctcaccatctcgtcattatactccattacataggtctggatcggaagccggtcaaccggaggctcctccaaaacactcatgtcacgtatcccgatcagactcatatggagcgtccttgggatcggcgtggccgtcagtgtcagaacgtccacattttccttgagctgtttgattttttctttatgggcaacaccaaaacgctgttcctcgtctatgatgagaaggccgagattcttaaacaccacgtcttttgagagaacacggtgggttcctatcagcacatcgacaaagccttttttcaaatcctccagcgtccgtttctgctccgtggccgtcctgaatcgcgacatcatatcaacccggaccggaaagtccttcatgcgctgcacaaaggtgttataatgctgctgggcaaggattgtcgtgggcaccaggtaaaccacctgctttccctcctggatggccttaaaagcggctctgagggcgatttcagtctttccgtagcccacgtcgccgcagatcagacggtccataatctttttgctctccatatccctctttgtcgattcaatggcctccagctggtcctccgtctcttcaaagggaaacatctcctcaaactcgctctgccataccgtatccgccccatactgatagccttcgctctcctgtctggaggcgtacagctccaccagctctttggctatctctttgacggcccctcttacctttgtctttgtcttattccactctgtgccgcccagtttattgagcttcggctgttttgcatcggctccggcatatttctggattccttcgagcctcgtcgcgggaagatagaggttccctccgtcccggtactcgattttaatataatccttgacgattttatcctgttcaattttttcgattccgcggtaaatcccaagtccatggctttcatgaaccacatagtctcctacggccagttccgaaaagctctgaatcttcttcccctgataggctgtcttttttctcttctttttctggcgcacaccgccgaacatgtctccttcggtaatcacgacaaacttgatcagaggatattcaaaccccctgtgaagattcccgtaggtcaccatgatctctcccggcagcacctggatctgcccttcgtccgggcagaaggccctcagattatactcccgtaaatcgcccgccagacggctggccctggttctggaaccggacagcaataccactctgtatttttctttcttccatcttgtcagatccttgattaaaagctcaaatccgttctgataggagttaacgcttttcaccgtaaggccaaatttcttttttacggaaattccgggaagtttctgctccagtccaagcatcatcagggtcctgtcccccgcagccatcgccatgaccgctttggccgggaacataaagtccgcctgtcccggaagaagatagccgttttccagcctgtgaaccatgctctcccggaattcttcctcaaccacctccgctttctcacgaaggcgcagaggctcatccatgaaaacggtcagtctgccctccggaaaataccgcagaaacgataccgtctcagggcaaaaataccggatgaaactaccgagaccatgaacccgccatccctccttaaggccttccgtcagctcgctgattaccgactcaatccggtgggcctcctccgtcttcatctgctcccgcagtgatttgacgtatttattcttttctttttctatcttcaggataccggccgccgcctcttctctggtaaggaccagctccgtcgcaggatagatcagggcctcgtcaagctgttccaccgatctctggctttccggatcaaaggtccggatggaatccacctcatccccccaaagttcgattcgaaacggtagatcttctgtcagaggatagatgtcaataataccgcctctgacggaaaactgtcccattccgtctacctgggcaaccctctcgtatcccattccggtgagggataccttaagcttatccacgtccagggcctctccgcttccaaccctgagacactgccgtttcagattttccaggggaaggaggtgatccatcaggccgtcgaccgtcgttatgacagcgcccccgctctcctccgccagatgcttcataacctgcatcctctgccttgtcaggaggtttccatggatatcagagctgtaaaacagcagatcccgggccggatataaatatacatcgggagaaaaacaccggtaatcctcgtaaagctccctggctctctgatcatcataagtcacaatcagcttccatggtatctcctttgtcagttccgatatcaggtgcgccttctgtgaatccatgcatccgctcaccagcagaggtccctgtcctctctccagctcccggttcatatccccaaattcaattaactcttcaagtggatttgcaaaaatgctttccatttcattccccgttctttctgagtataactctctttgtctccgcttttatacttcggtttccggtttttccgccgtttttttcactgtcctggccgcaccgttgaaacggttcattgcggtatcaactccatcgttcatcatcgccacggctgccgcagctccatccttaaatgcctgctccatccgatctttctcttctttagaaaaatgtcccagaacataatccgccaaatccatcctggccggcttctcacctaccccgatccggatcctgggaaattcctgggttcccagatgggcaattatatttttaatgccgttatggccgcctgcgctgcctttcttgcgtattcttatctgccccggctccagactgatatcatcatagatgacaataaactccgaaggttccgtcttataataatccattacggaacggatgctctccccgcttaaattcatgtaggtctgcggctttaccagtattaccttatttccctcaatcattccttttccaattaatgccttatgcgctttttccctaacatcgatattataccggtccgccagttcatccagcgtcataaatcctacattgtgcctgctgcccgcgtactcttttcccggatttccaagtcctgctattatatacatatgatattttctcctttatacgatcaaaatgattctgcttcctgatttttgtctgccacaggcacgccttaaagcgttagaatttccttttccggaatatctaacgctgtattcagccattttatcaggttttttcggtgttgtaaagggatgggaatttaattaagcagatgaggatgccgccgggacggaagactcagacagaatcccccaccacatcggacgcgtcctccgaacctcaaccaaatctccattattctcttgccgtctatcttttattatggtaaaattggggtgttgtgcttatataagttcatgattgggtgaacgtttctaccaactaccggaatagttgactataggcggcagcctgcctgtcgtttaccattccgcggttggttttttatttactccagccggccagatataataaaaagttaaagggggcaatatttatgaacgaaatgaatcaggcagatgtaatcatcatcggcgcaggaccgtccggtattttctgcgcttatgaactaattaaagaaaaaccggatatgaaaattttaatgatagaaaagggaaggcccattgaaaagcgggtttgcccaaaacggaagacaaaggtgtgcgtcggatgcaaaccatgctccatcaccaccggctttgcaggcgcaggggcgttttccgacggcaagctttccctgtctcccgatgtgggcggcaatcttccggagattctgggctacgacagagcgcaggagctgatccgggaatcggatgatatttatctgaaattcggagccgaccaaaacgtctacggaattgacaagcagaaagaaatagaggaaatacggcgcaaagccattaccgccaacttaaagctgattgaatgtcccatccgtcatcttggtaccgaggaaggttataagatttatacccgccttcaggaacatctgatagaacagggcgtacatatgctatttaacacaatggtcgatgatattatcattgagaacggagttgccaaagctgtcgtaacagacagtaaagaaacctacagcgcaggcgagattatcgccgccatcggccgcgagggctccgactggttcagccatatctgcagccgccacggcattgagacggaagtcggtaccgtggatatcggtgtccgtgtagaagtccgcgacgaggtgatggaattcctgaacaagaatctttacgaggctaagctggtctactacacccctactttcgacgataaagtgcgtaccttctgcaccaacccgtccggggaagtggcaacggaatattacgagaacgggctcgctgtcgtaaacggccatgcctataagtctaaagaatataaaacgaataataccaactttgctctgctggtatctaaaaacttcaccaagccgttcaagacgccgattgaatacggcaaacacatcgcccagctcagcaatatgctctgtgacggcaaaattctggttcaggcttttggagatttccagagaggcagaagaacgacagaggaacgtctctgccgcaacaacctgattccgaccttaaaagatgctgttccgggagatttatccttagttcttccgcaccgcatcatggtagatattaaagagatgatcctggcactcgacaaggtcactccaggcattgccagcgatgaaaccctgctgtacggcgtagaagtcaaattctactccaacaaggtcgttgtgaacactgattttgagaccagcgtacaggggctccgcgccatcggggacggtgcttccgtcaccaggggacttcagcaggcgtctgccaacggaatcagcgttgccagaagtattttaaataaaatggggatttaactgaggttgggaggacgcgtccggaacggaccatgtccggtgtggtgaggggactggctgagtcttccatccccgggtggaggttgtcgtgaggggggaatccggccggaatggattgctgcggggaccgtttgcactctttggagtacgcaacagtgctaagctcgtgagggacctcgctaagcaccggcggactcccatgtcccctccgcaattgattccgcctacttccccggttcaggttttcgccggggacggaagactcaggcgaaggttttcgcgacgccggacatggtccgttccggccgctgattgtctccaaccttaaatggggatggccttgtcgcggccactacgtatttacggcaaactgaaatcaaaccttccgcaattctttcataagggcgcatttaaggcatatcatattttccgcacacgaaagcgctgagtggtctcgacaaggtccgccctccgcacttaacgcgtgagacaatcagcggccgcaggccagcggacggggccgatacacccggcggagtctttcgtcccggcgaaaacatagccttggggcggaggggaagataaagtctgcggatgccgttgaaatccatcgctgattagcgaggtcctgtcgagcttagcagcgcgatgaatttcacagagcgggagtgtgctccgcagactttatcttcgcccgcagccccaaaccacgacaatctctccccgggacgaaagactcatatacacaccccaccatcccgtccgctggccgtaccggcggcgtcctcacctgcttaactaaatctccactatttttcctctattatgcgtattgcttcctgaagctggttatccatatcctccggaattacaggcatcttggcagcctcttcattcagctccacctccacgtcaggagcgattccttctccgtgaatgtcgtgtccgttcggcgtatagtaatgatttgtcgtcagttttacggcgcttccgtcggaaagcgggaagagcgtctgcacaattccttttccgaatgtctgtgtaccgaccactgtggccgcctcataatccttcagcgcaccggtaaatacctcagaagcgctggcggagttgccgtttaccaataccaccatcggtatctccagactgtgaccgtctttggcatcatatacctcttctgcgccttctttatccgctaccgtaaggatccgcccgccgtccttcaggacgtaatcggccatggatactaccgtattcaattcaccacccgggttatttctcaagtcaacaatcagtttcttcatcccctgagtgtttaactcctctatcttctgcttgaactgggcatccgtcaccttgtcaaactcaattacggaaatatagccgatctcgtcatccagcatttttcctgttacggtctgtacatcgaccggttttctcgtcacggtaaggtccacgtattcccctgtatcttcccggtaaaccgtaatctctacgttggtgtcttcctcgcccttgatatagttgttgaccataatagtcagatccatccccgttacttccgtatcgcctacggcaaagattatatctcccggacggattccggctttctcggcagggctgccttcaaatacacggataatcgtggagacgcctgtcttcctgtcctgtgaaaccatcgctccgataccgcagtaggaaccgtttgtctcatccataaagctggccagttcctccggcgtatagtaaactgcgtagggatcattcaggccgaaaaggaaaccgttgtaaattccggattcttccttttccacctccaccttatcttcaaacaggtacttcttgtcaataatcgtctgaagctccgtaagctttctgttgacgcgctccatatcgagagtctgattgccagcctgaccgtcggcgctcgcctccgccccggaattaccctgctccgcctgcacctgtacctgattgtcaatgacgcgccgtccaaacatataaattccggccgatgtccccactgtcaccaggcaggcgaatgccgtaacaaggacgccgaccatgacgcctctccagaatttacttctattgtccatctctaatgcctcctaatttatgggttgatattgtttcactccacgctcgatatattgtcagagtgcgactgcatcctacgtagaagcgtggttgaactcatggcagtgggggaaaaccgattattctccgcccaccactgccgttaagtttgtttttgaacttagggcctctgttcagtaagagtaccgaaccgtttccctatgggcttacatattttgccggatttacataacttccattcagccggacgccgaaatgcaggtgcggtccggtagaatagccggtagaacctacttttgcaatgacctgtccctgctttaccgtgtcaccggctgataccagcagctgggaacaatgcatatacacggtggatactccgccgccgtggtttaacatgatatagttcccggcagaatagctgtatgtagaaattgtcacagttccgtcggccgccgcaacaatattgcttcccgtaggcgcgccgatatctattccctgatggtttgaagaagcgccttcggtcggtgactctcttcctccgaagccggatgtaatcctgctgctggaaggacacggccatataaatttaatattcccaatacttaccgtattatacttctgccctgccgcctcagcctttttcctggcttcctcttcctgtcttttgatctccgcctctatctgtttaatcttatcttcctgagctttgatatccttttcataagcttccacctgagccgtcttggtcccaatctgggaatttaccttcttaagctccgccgatttttcattgaccagcgtctccacagaatttttcttgcttgtcgtctgctcctgcagcacaaccagctccgccttctctttctcaagctgcgccttgtcatctgctatcccgtctttgactgcagcatattgatccagcatatttctgtcatattcagatatttttgaaatatattccgctctgtttaaaagctccgacatggacttcgactgcagaagaagatccaggtaactgctgtcacccttctcgtacatgtatttgatacgctttttcatggcctcatactgcttcttttccacttttccggcctcatcaagctttaccgcggtctcttcaatagtcttctctttatcacggatatttccttccagcctgttcacttccgcattcagcgtctcaagctgggagtccagcttccttacataggtttccgtatctgctttcagtgtttccagctctttgatagcctgctctgtcttctttttctcctcctcgatggaagaaatctttcccttggcgctgtccacgtcttttttagaggccccatatgcgggcgctgcggccagagatgccagaagaatagccagaactgttctttttactgctgcattatgcctcatcttttgctccttatgcacagactcctataccttcagatgtttccgaatggtaaagaagcttccgacaaaaccgattcccacaccgagagccaccgccactgcgatcatatacgggaaaatggtgtcgattggtataaactcaataatgttagatatgatatggaatttttcaatcatgtattccaccgcgctcttgtaaaggaaataaacgctgacaagcggaatagccgccccggcaaatccgataataataccctccacaacaaagggggcgcggatcataaaattggtggccccaatcagacgcatgattttgttctcgtccttccggaaggccgctgccgtggaaatcgtattgctgatcaggaacaccgccaccgccagcagtattgcaataatcactgccgaaatcagccccagcatcttattaaaggtggaaagccctgatgccgtgtcattggaatagttaatcttcctgatacctgcaatcgtattcagataggacacaatgacatcctgatccgcgatatccttcagataaatttcgtaagatgccgatccggccagcgggttatcatccgcaaagccttccgccagttcctccgcatctttaaaatattccttctggaatgtctcccatgcctcctcggctgaaatatactttgtttcttttatctctttcctggcggctatctcttttccgattgccagaatatctgcttccgccatattttcatcgaaaaatacagtgattcccaccgtggtttctgcatttttcaccatatactgtacattggccaccagggcaaaaaacatacagaataaaaaaatgcacgctgaaatgatagccgtcgaagccagggaaaaccagatattcctgcctatatttttcataccttctttcaggcaatatgtaaatgtactaagcctcatatgcgataccgccttttatctcatcctccgccacaactccgcggtccagggtgattacccgttttcccatcctgtttacaatctcctgactgtgggtaacaacgactacagtggtacccctgttgttgatttcttccaacagcctcattatctccattgaattctgcgcatccagattaccggtcggctcatccgccagcagaacctcgggcgaatttatgagagccctggcaatcgccaccctttgctgctctccaccggaaagctggttcgggaatgatttatattttgatgaaagccccaccagcctgagcatctccggaaccgactctttaatcgttctggtcggcacaccgattacacgctgggcaaaggctacgttttcatacactgtcttatcctttaaaaggcggaagtcctgaaacactacccccaaacgcctcctgtatttcggcacatatcttctgggcatcttccccagctccatatcgttcacgatgattttccctgatgacggctccacttcctttaaaagcagcttcataagcgtggatttaccggaaccgctgcgccccataataaagacaaactcaccgtcctctatcgtgatattaatatttttaagcgccctgtttcccgctttatatgtcttattgagactcattatctctatcatcttctgtgtatccctcaactatagaattgctgcggcacagatacgcgatccataccacagcattccccgtttccctctgtttagatttgcttcaagatctcaccgttaccgttcacgtaacatctcatcatcaataatcaaggttctccatatacttcatgtatttaactaccataagcgcaattttaaaggttatggcatcttcaaataccctcaaatccagaccggtactcttctgaagcttgtcaagacggtacaccagcgtgttcctgtggatatagagctgtctggacgtctctgatacgttgaggctgttctcaaagaatttgttgatcgtggtcagagtctcttcatcgaaatcatccggtgattttccgtcaaaaatttccttgataaacatccggcaaagagggagcggaagctggtaaatcaaccggccgattcccagtttgctgtaggccacaacattctttgtgctgtagaaaattttccccacgtcgagagccatctttgcctctttataagaacgcgatacatccttaatctcattgacaatcgtaccaaaagcgacgttcactctcgttagcgcctctgtattcagcatatcaacaatcatgctggccgtcttctccaaatcatcataggtttctcccggtttcacttccttaaccagaataatatccttctcatccaccgccgtaataaaatccttcgtctttgtggagaacaggcttctcaccgtctcaagcgcattgacatctttctcatgctgtgtctcaatgataaagacaattctcttaacattggtctcaatatggagcttcttcgccctgttgtagatgtctactaacagcagattgtcaagcagaaggttcttgataaagttatccttatcaaatctctccttataggcaacaagcaggttctgaatctggaatgccgccatcttgcccaccatataaacatcgtcactgccgcccttggcaagcagaatatattccagctggtgttcatcaaacaccttaaaaaattgatagccctgaataacctgactgtccgccggagagtccacgaaagtcagaatcgcactttcatactcctcagcaccggtaaatgtggacgcaagaactttgccttctgtatcacagatacttaagtccaccctggtaatccccttcaagccttcaatatttgtctggagtatctgatttgatatcatatccttctctcctttgattttatattttccctgattactatattaatgcaaaacggagaaaaataaaagagggtgtctgaaaaaaattaaaataaatattatttaagcaggtgatgtcccctccgcaattgattccgcctgcttccccggttcaggttttcgcagggacggaagacccaggcggaaatttccgcgataccggacatggtccgttccgggcgctgattgtctccagtctccgagcacaggtcatcgccatcaatcacagcaaattgagcggaattaaatccggtgatactcttccggactcaattccgctcaatcgtattgaaacatcaaatttatcaaacaaatatggatgcactgagtggccgcgacaagatccgcccccgcacttaatgcgtgagacaatcagcggccgtaccggcggcgtcctcacctgcttaactaaatccctatttcattgactcaataatactgtcagccagtgcatccagctccgttaccttgtcagggtgaagggcggatgccagggaaagcctctcatttaatactgtcatatttttaagctcatcatccacgaatttctgcattaagtcgcctgatttacatgcccatgagccgttctctatgatggcgattgtcctgttctgaagattgagcgccttcatatccatcaggtaattgtgcattaccgggtaaattcccagattgtaggtcacggatgccagaaccacatgacttaaacggaaggtctcggagatgagctgtgaaacgtgtgtattggatacatcatatacatgcacattcgtcatccctttttcacacagctttaatgcaagcgcctgcgcagcggcctcggtgttgccgtacatggaagcgtaagcaatcataacgcccttttcttccggctcataccggctccagtgatcgtatttgtcgatgaaatagcccaggtcggagcgccataccggcccgtgaagcggacagataactttaatatcaattgttgcggctttctttaagagcgcctgcacatgagggccgtatttgccgacaatatttgtgaaatagcggcgggcatcgtcgatccagtctctgtcgaaattcacttcgtcattaaaaagtttaccgtccaatgcaccgaaggaaccaaaggcatcggctgcaaacagaacgccgtttgtcacgtcaaaggtaaccatagcctccggccagtgtaccatcggggcatagacaaaggtaaccgtatgctttccgaatgacattgtatcaccttcgtgtacctcaatcagctcatggctgtcaacgccgaagccgaactggcgcatcagcatgaacgccttttccgtgctgacaatcttcaccttcggataacgcagaaggatttcctcgatagaggcgccgtgatccggctccatatggttgattaccaggtaatcaagaggttttccctccagcagatagtccatattttcaagcagctggcggcaggccgaccagtcaacagtgtcaaataaaacactcttctcatccagcagcaggtatgcgttataggaaacgcccctgggaatcggatgtatattttcaaacagggccagacggtggtcgttggctccaacccaatataaatcttccgttacatttcttacacaatacataaagtgagcctcctttcagcttacgcctcgataaacatatcttttccttcagcacattccgggcatacccagtcttccggaagtttttcaaacagagttccgggagcgatgtcattgtcaggatcaccttccgccggattatattcatatccgcagcccccacagacataagtcttgccgattggcttttccttcggcagctgtggacgtttcatcttaatcattggaggcgccggctgtttggcttctccattgtcaagcgctgccgtcagaagcggaagtatctccattacgtctccgacaattccatagtcgcagttcttgaagattggcgcattggcatttttgttaattgccacgatgatggacgcatctttgattccctttaagtgctgtgtcgcaccggagattccgcatgcaatatataggttcccggtgaatttctggcccgacattcccacatagcggttcaacggcacatatttaagtgtctcagctaccggacgggaagagccgatagccgctcctgcctgtacggccagggcttcgatcagtttcatgttctttttatccccgattcctttgccggccgacacgacgcgctccgcctgcggaatcggtgtgtctaacggtatgccgacggaaaaatcaaagccgtcttttttcagggcagccacaagagtatcaaccttttcctgcgcctttccctctttcagaatctgtttcttgcgaaggccggtgatgggggctggtttcttcatatgctttgccccgccgcctcctgattccttcggcatcttgccaatgatatgggaagcgataacaactctctgaatctcgttggttccttcataaatcgtcgtaatttttgcatcacggtatgcccgctccacttccattcctttcagatagccgctgccgccgaaaatctggagagcatcattggtaacctcgagagcgatatcggaagcatactgtttagccattgcggattccattccgtacggtacatgctgttccttcagctctgccgcgctgtatatcaggaaacgggcgcagcgcagttttgtcgccatgtcggccagcttaaaggaaacaatctgctgctggcagattggcttgccgaactggattcgctcctttgaatattccagagcattttcataagctccctgggcaattccgagcgcctgggatgcaattccgatacggccgccatccagcgtcgccatcgcaattttgaacccttctccctcttttccaaggagattctccttcggaaccttcacatcgttgaaaatcaattctgccgttgaggaagaacggattcccatcttgtcatagtgatcgccaaactcaaaaccttcccagcccttttccacaatgaaagcggaaattcctcttgttccgatatccggtgtcgtcaccgcgaataccacgtatgtatctgctttcggcgcgttagtaataaaaatcttaccgccgttcagcaggtaataatccccttttaatacggccgttgtctctgtgccgccggcatcggaacctgcattcggctccgtcagtccaaacgctccgattttttcacctctcgccagcggaaccaggtatttctgtttctgctcttctgttccgaacgcaaatatcggccaggatccaagcgatacatgggcggaaagaattacaccggctccgccgtccaccctggacagttcctccactgcgatcgcatagctgagtatatccataccggctccgccgtactccttcggataaggtatacccattaaccccattttcccgagcttttccacggcctctgccggaaattcattgttctgatcgagaagaaacgcctgtggcttaatctcaccctccgcaaactcgcggattttcctgcgcagctcctcatgttcctgtgtcgttgtaaacagcatatgctttcctccttctcctttttggttttaatcatgcatctatcgttaccgccgtgaatcaggcaggtaatatcaaaccagctctttcaattaccgctttaatattgtatgaacaaaactgtaatttatacttgataatttttatccactttaaattataaagaatgccgcctgctgattccgttctcagcggcggggaatcgtaacagttcaatcagtctgaactgttacgggaattcctctttactctaactgttctcttctccgttcaggagccagtacaggctcctggagcggaattcctgatcaattgcattctgtacttttgccagttgtgtatggatggtgcagggcgagccgtacctcccccgccactcacactggtatccgggcgtcatacaggacgtcaggcgtgcgtttgtctccactgcttctatcaactgataaagagttgcggttcttaaatcacagcccaggcggcagcctccgctggctcccctcgttatctgtacgatccctgctttttccagtttcttaagaatcttatatgcgaacttctgaggaaggctttctctctctgccagctctcctgccgtatagcttttaccatctgacagggtacgtaaaatgcgcagtgcataatcggtttctctggttatcagcacgtttccaccctccctgttgtctataacactactatagcaatgtagataaaaaatgtcaagtttattttggaaattttgtataatttatgttattattcattgccgtaatattaccgatactccatccggtatcggcccacggaataatcattctctccggaggtgactgccataccttccttttccttcgcagaatgttccgccatacctgaggatgacggccggaaacaaaatttatatgaccgaagattcccacgaaaacatccggcgctaactcagttcggaatatgatgggctgctgtttgccccggaaacgtcggagtaacatggaagtacaaaaagaaatacagataatacaatatggcgcttatgaatattaatatttaaacatgatactatccatgctataggaaacgtaagaattgtaggtgtaatcaagtaaaacacgccaaactgctcacaggtcaccgccatcaaaaaaagaagaacgctttcagacatatcaccgaaagcgttcttctttattaaatatgtaatttttaaactgtctctttcaaacttgttgactcttctcttaatttaaaataaccttctctgtctctttatcaaaaatatgtactttagacagatccagggcaaattctaccgtatctcccggacgtgccgtcgttcttggattcactctggccgtgcagctgttctcctccacatcaaaatacaggaatacttcggctccgagcatttcatatacacggatagaagccttaattgtcgagcctgcggctgctttgaccgcttcctcctcgtcatgcagatcttccggacggatacccatgatcacttcttttccgatatagccggcctcttcaagcgcttttcccttttctgccggaagtacaatcgtatttcctgcaaaggtaagagtcacggaggagcctgatttgctgacagcagaatccaaaagattcatctggggggcgccgataaatccggcaacgaatttattagccggtttgtcataaaggttctgaggtgtatctacctgctgaacaaggccgtccttcataacaacaattctggttcccagcgtcatagcctctgtctggtcatgcgtaacgtatataatcgtggttcccagtctctgatgaagcttggaaatctcaatacgcatctgccctctgagcttcgcatccaggttggacagcggctcgtccatcagaaagacctttggattacgtacaatagcacgccccatggcaactcgctgtctctgtccgccggaaagagccttcggtttgcggtccagcaagtgggaaagatccaggatcttggccgcctcctgaacgagccggtctatttcatccttcggcatctttctgagctttaagccaaatgccatattatcgtaaaccgtcatatgcggatacaatgcatagttctggaaaaccatggcaatatccctgtccttcggttccacgtcattcatcagtttcccatcaatataaagttctccggacgtaatatcctccaaaccggcaatcatacgaagtgtcgtggatttaccgcagccggaaggtcctacgaaaataataaattccttgtctgcaatctccaggttaaagtctttaaccgctacaaatccgttcggatatttttttgttacatttttaagtgataaactggccattcttcttgttcctcctgcctttaatacatagtcacgctgtctcttctcattctgtatgtattaatcctatcatgactccgcttatcacactatgttttaaatgccacaaaatcaattctctgttttgagcattttgtatatgatgaaaaaaaagtgtccaaaatgtcaaattaaaatgttctacttccggcgaatccgttcatatttggtacaattgtttaaataaaaaacaaatttgtgaaaactcaacaaacttacacttccgcttctgtgcaatccttttgacgttaattttaatttgtctaaaatagacaattttttaccgtttaaaaagctaaaaagacgtgaaggattaccgcttgacaagtaatttgctcaaagaaaagattgttctattcccaacaaaaaaatccccgagcagcaggggaaacggtttctcctcaccggctcagggatgtgttcggaaggtgcggttattatttcaaagcaatcgcttccatctccatcaggacatctttcggcagtctggcaacctccacacaggaacgtgccggacaatctccctcaaaatatctggcataaatttcattaatcttggtaaactcgcccatatctttaatgaacaccgtcgtcttgattacattcgccattgaggttcctgccgactccagaaggttctttacattctccatgacctgctcagcctgggcttcaatcccctccgggatttctcctgtagccggatttaccgggatctgaccggatgtgtaaatgatcccatttacctcaattgcctgtgaatacggtccgattgctgccggcgccttctctgtgctgattactttcttcatgttttttcctcactttcctgttcttttgatgtttttttctgttatctctatcttaccttcttttaagagatgtcctactgcacgtttaaatgcattcttgctcaggccaaattcccgtcttatcacctccgggtctgccttatcgttaaatggaagcactccgtcaaattcatcaattgccttcagcacaagctccacatcgttgtccatctgcagatacgctttttccctgaggctcagatccagcttcccgtcctctctgaccttagtcacgcgggccctcaccacttcgccgggctggcacttggagaacagctccttcttcggaatcagcccgtaatactgatcatccaccgcaacaaaaactcccagattctcgttgatttcatatacccggcactcagcccagtcatcttttttataaggtgcatgattatttaaatacgaataaaccttcgttgttgccgccaggcggccgctcttgtccacataaagggcaaccaggcattcctctccgactctgaccttgtggttctgctccttaaaaggaagcagcacatccttctccagccccatgtccagaaacgctccgatttttgatacatcattcactttcagaagagccgtctcccccacctgcagctttggcatggcggtagtcgcaatcagacggtcctcggaatccttatagataaatacccggatcgtgtccccggtctttgtcccttccggcacctgttttttaggaagcagcacggaagcttccgcgtcctgcttctctcccaggtaaactccgaattccttttcccggagtacttccagttcctgtattttccccaattctatcatgtcattcgtcctctcttttctcggccagccatatgttggctaatacattacccgcggcgtcctgaagagataccacatatccctccgctgttttgccgatcttcgggtacatgacatcacccagcaccgcggcctttttatattcggtcctcagctcccggatagtaaatttctccggcagaagctctctggcaatctccacgtactgtgcgttgttcacatgctggttcgtgtcaatatggtgtctcgccgccgtaaccggctcagcgctttggcagtcttttggcagcacaatcttcctgggcgcaggcggaagctcaagcttctgctcccctgctccgtagccccgtatctcgtcctgtgtgaccctggccggacaattattctccaaatcataaaagaaccagcatgaatctgctctgacgagataatttccttctaaatcggtgatcgtaaaattcctgtacccatagatccccttaaagccatatggccatgtcgatattttgatacgctcgccaagtcccggacagcggtcaatcaaaatctgccatgtgttcagccaccaggccctcttcttatcataaagataggatagccctaatttcagatcctccgactggaatgtggaacagtcctgcagataattcatgattccggttaccgaaagtttcccgaattcatccatctcactgtaccgcactctgctttcaaatgtatacatagtccacctcgctgtcgtatcggtatgaaaatggcctgtctcatctgccgctataccgatactctgctgctattatagctgattcggccagacttgtccagtttgccgtttcgcgccgcacaactcgggattttcgcaaaaaacagcgaaaacacctcgcggaatacatcatggctgatctgttaccagcaattcattccgttcggatctcccacacgagcagcctccccacggggacggaagactcagaaaaccagccgaaccgcaccggacccggtccgttgcggacgcgtcctccgtttacaatcagttttttattaatttatttttataataaggcttgacatcttacaaatcccgaagtataatacagatcgttatttcattgggccatcgccaaatggtaaggcaacggactctgactccgtcatttcaaggttcgaatccttgtggcccagctttaagaagagcatttagtcagccaacggcggcagactgatgctttttttgtttaacaggatacttctcctgttaaataaaaaccgctccgcggagaatcccgcgagcagaattctttcttgtttattaattcaaaatctttcatcatattcgcgaaaagagccttgccgggatccctccctcacaatcccggcacaggctctatttatataattctgtaatcatgatatccgggaacatcttccacgggccttcctccgatgcttttggccgctttgactgctgctcccgccgctcttatcgtctcataccttttataaatgtatatatcagccaaatcagaataatcgggcctgcaaagcgcataagaagtgcgaaaattccgccaatcacagtgattaccgtaaccatgaaaaagactacgattacaagaaggagcagcttccagtaccatttattcagattgaaataacggaagcttccgctgcttccggtctcctgctgcccatagccgcttccctgattctcataatagccgcttccctgttccgggacatcaccggccgcctcgctgctgtctataatcgtcctggcaatcagtctcggactgcctatctcatcaattacatcctcttccctgcgtccggccgccgtctcctgagtaatatagttgtcataatatctcaggttttcctgcagcaccccgccggaaacctccccctgcaatgcttccttaagctcctgtaaaaattctgatttcctcatgttcactccttagcttgcgcagcctgtattaccgtatcctctctttcagagcgcctttccggtaggctgccaccagttcttttaagtcttcaattcttcttgccagttctttaccgtcatccgtatcagccaccataatacgtttgcgcatcttttctacaatgctgacctttggagtactttcttttttcgggtcaaagggtttatgctccgccaaagccagatgcctggagttaaatatcagcgtataaccggcgataccggtttttccctgatatgctttggaaagtccgccgtcaataataaacagctttcctcccgccttgattggagtctccccatccttaatctttaccggtacatggccgttgataatgtgggaacctgtcgtcgtaaggccaaactcctccagtatcatgtcgcagtatttttcctgcacactcaatttataatatggattcatcctctccctggaagcttccttatcttcaacaaaataatgttcgaatatggtcatcttatctttcccgaaaacaggagatttagccccgctccaaagataccacataaaatcacggctggcctccttctccggatcctgatccggtaggaaatatgctttttttacctgcttgtcgataaaatccatcagcgccctgcccttatacgcttttccattaaccgccatctcatcaaagctgccgtcctctttcattggaatacagccgtgataaagaaggttggaattacagcatttatacatactgccgttggaatacaggaatttaatatgcttgtggagaagggcactgtggcagaacgacagtgtcagcgtatgtaaaagttcttcctcttcctcagaaagcttcagcggatccgacggatcgatggtgggaaattccatatccatcatcggatattcctttccctctatcacaaccgttcctctctgatagtcgatggccgtcagaaggatacggctgtccatctcgtactcgggatggcgtctgataatctgcccctccaccttaaactggattacggctattgccttatgcatctttgcagcaagcccaggatccaccgcatcgtaaatattctgatccagaatacgcggcatgaaccgctcgcacggatcatcactgtacacctttgcggcaaacatggaaagcggcctgatattaattccatatccatcctccaggacgtcaaaaccattataactaatggcgatccgcagcacattgcagatacaggccggattgccggtggaagctcccatccacgagatatcatggtttccccactggatatccacatcatggaactgcatcagctcttccataataatatcagccctaggcccccgatcgaaaatatccccgataatatggagattgtcaatcgtcagattctgaatcagacggcacagggctatgatgaaactgtccgccatctgggtgtcgataatcgatcggataatctcactgtagtacacctttttattgtcgtcattgtagtccacatgcaaaagctcatcgatggcataggcaaattccggcggcatcttcttgcgcaccttggaacggctgtatttagacgacacctctttgcatatctgtacaagccggtagagggctatcctctgccagtcctccgtatagttctgctcctgcttaagctttgcaatctgcctgtccggatagtaaatcagattagccagttgtatctcatcctcctcggaaataatatgtccgaaggtttctttaatcttctcacgtataataccggaggaactgcggagcaaatgaataaaagcctcatattccccgtgcagatcgctgaaaaagtactcggtaccctttggcagtccgcagattgccatcaaatttacaatctcactggatgccgactccaatgtaggatactcgcgtgacatcaatttcagatatgccagatctctcattccacatcccccctctgcctcccgtcaggctgcgtatcgttacagttcagcctactgccaaactgcagcaaatgatacaatgaaacggcaaaaaacgccgttgattgtggtgaaatgcctgtccggttgcttttatgataggtttatagtatcataagatggaaaaaaaataaagatttagttaaactgtctatcttaaggaggtttccccatgcagaaagaacttctctatgttttcggcaccggcaatgccgccgtcaccaggtgctataatacatgttttgccatacggaccgtgaacggcgaattctttatggtagatacaggcggcggaaacggtattctcggtatcctggaggatatggaggtacccctgtctaaaatccatcacattttcatcacccatgaacataccgaccatatcctgggtattgtctggatgatccgtatgatagcaaccgctatgaaaaaaggcagttatgagggctgcctgaacatctactgtcatgacggtctgccggacacgataagcacgctctgccgcctgaccatgcagaaaaagttttacagcatgataggcgaacggatccatctgattccggtgaaggatcaggagtccatggatattctgggacttaccgtcactttcttcgatattctctcaactaaagccaggcagttcggttttaccgcccttcttgccaatggaaggaagctgtgctgcgccggtgatgaacccttaaatccacggtgcgaacatcatgccgcgggcagtgactggctgcttcatgaagcgttttgcctctatggtgacagggagcgttttaatccctatgagaagcatcacagcacagtgaaagaggcctgtgagcttgccgagcgtctccatattccttcccttattctctggcatacggaggataaaaacatttccggacgcaaaaagctctatacaagtgaaggaaaagagttttaccacggacggcttttcgtacctgacgacggggaaatcatcgagctttgaatacaaattagatttaactgaggtttggaggacgcgtccgtaacggaccatgtccggtgtggtgagggggatggctgagtcttccgtccccgtgggcaggttgtcgtggagggggaatccggccggaacgaattgctgcggggaccgtttgcactctttggagtgcgcatcagtgctaagctcgtgagggacctcgctaagcaccggcggactcccatgtcccctccgcaattgattccgcctacttccccggttcaggttttcgccgaggacggaagactcaggcgaaggttttcgcgacgccggacatggtccgttccggccgctgattgtctctaaccttaaatggggagggccctgtcgcggccactacgtatttccggcaggcagatatcatatcctccacaattttttataaaaggcgtattgaaggcatatcgtatttcccacacacggtagcactgagtgcccgcgacaaggtcagccctccgcacttaacgcgtgagacactcagccgccgccggccagcggacggggccgatacacccggcggagtctttcgttccggcgaaaaccttccgggagaaggagatactgccgacatcttccggcggagaaggagagaatgatatccggaaggacgttcgcccgagagatgatagctcttaggcagagggagacaaagcgtgccgggcggattttagccctacaagggcaaaatccgggacaacttgagcttcgaactcattcggagttcggagcgaatttgtccgtaaccccggggggctttgccttcctctgtcttagagctatccctcgaagaagcagtccagccggatatcattctctccggctccgccctgcgaaaacaaaaccacagtatctccttctccatccagcgatgcccccccccccgggacgaaagactcatatacccccaccaccaccccgtccgctggccgtaccggcggcgtcctcacctgcttaactaaatctccatagtattttcatcgcatagctgagctgtttctccttatcttggaaggagatgataaaaagtcatggtagtagtagctaaaagagcgcctttatcatcataaatttttgaatcgcaaacagaaaatgtctttccattctttatttccactgcctccgcagtaatctttgacgtatttttaccggccctcaggtaattaatgcttccatttaccgtcgtaacccggtattcgccggatgctgccgcagctgtcccggacaccgtgtccgccagtgaaaacaggacgccgccgtgaatgactcccagtacattcaaatgccatggttctatctttatttcacatttcgcatagccgggccttctttccagagtttcgatccctattttttctctgaaatccactccgtccggtcccaaagccccgccttctgcataaatatcggcatacgttccgccccggttctctgtctccgggatttcctttacggaattttctgtttctgcttctgcttcctttctgttatcttccatataatcatcacacctttctctttctacggcaattgtaaagtatcaagttgttactgttcacggccacagttacagttcagccttcggctaaaccgtaacaaatgatgcacagaaacggcaaaaaaacgccgtttcgcgccgcacaactcgggattttcgcaaaaaacagcgaaaacacctcgcggaatacatcatggctgaactgttaccggccacaggcctttcaaacaggcatattcctacttttccagacatatgatcataagagacacttttttcagacttttagtccatgatattgctcatggtctgatgcagtgtcaggatataggaaaggggaatctgcttgaaccgaattataaaaaaagtaacggccgggttcgaccggctacttctctttctacataaacgacgaaccggaatcatcatcggccttgaagctatggccgttctttttctgctcacaggctggtttctgggcaaaaaagggatatctgcttcggccactcctttttccggcaatctgttctccatttttcacagggaggaggatgcctccaccggcaaaaatgcaaaagattttatcaaatgggttgactttgatgtcacctctgaggctatgacccaggcattccggtatgatgtggctacttgccagcaggatattcatttaaactggattgaactgctttcgtatctcggcgccaggtacggaggcgatttttcgcgttattcctcctccgacatggacaaattggcagaacagttaaaaaacggcacttctatggacgaactcacaaaagatctgaagtattactcctactaccttgaggcctataacgccgttttgggcggcatggtcggatattatgaaatccagataccgcaatccgaagcgcctgcctttgccctttcagatacccagataaatgaaggcgatcccggagccagcggaagcgagggtgaaagccctgattccgccggcaatcaggccccgtccgttgaacctctgacgccagcaggcgaacagaaggtctgggtgacgaaatacggcctgaaggcgtttcacccgctggcaaaaaattttccctacagccattatgatgatttcggcgtatcacgctcctatggataccgcagacagcatctgggccatgacatgatgggacagacagggactccggttgtggcggtcgaatccggctatgtggaggccatcggctggaaccagtacggaggctggcgtctgggaatcagaagctttgataaaaaacgatattattattatgcccatctgcgcaaggattacccatatcaggcaaaccttaaagaaggcagcatcgtcaccgccggagatatcattggatatcttggacggaccggttacagcgctacggaaaatacaaataatattgatgaatcccacctgcatttcggaatacagttgatttttgatgaatcccaaaaagagggaaacggcgaaatctggatcgactgctatgagattatcaagtttttgagtattaaccgcagtgaatccgtcaaagtggacggcaccaaggaatggacccgcatttaccagatgaaggatccggcagttggcgaggttactcagtagagggctaaaaaagttactgttcacacggcaatgttatgatgttgggatatgaacagtgaccttaatagcctgcaaaacagtatcagattctgtgaataaacagcccgctgcgaagcttcggctcaaaccaggttgacttcggaggcatcagaagaccggcatccgcaacggacagaagctctgccatggaagtcgggtacatggaaaaagcgactgccatatccgtatccgctctcctctccagctcttttgttccgcggattcctccgataaactcaattctcttatctgtcctcggatccccgatcccgaggacaggggccagcagatgatcctgaagcagggaaacatcaaggccgcccaccggatcgtctgtcataatctcctctttcgccttaagcgtgtaccagaaatcgtcaagcagcatgcagatttctccttttccggaaggtactctgcaggagtcaatttcctcccccatcgtctctttgctgccctgcgctctttgcatttttcctgttatttcaaatttttcccggactctgtctaaaaattcccggctgctcagcccgtttaaatccttcactaccctgttataggccataatctgaagctcatcgtcagggaaaagcacggaaaggaaataattaaattcttcctctcccgtatatcccggatgttccccgcgccttttaagcgcgaccttcacggcagaagccgctctgtgatgcccgtccgcgatataggtaaacgcaacggccgcaaattcttttgtgacagccgacacccactcaggacgtgcaatccggaacactctgtggcgcacgccgtccggggaagtaaaatcatagagcggagcctccttttttacctcggcctccagcgcctttatgctttccctggagcggtacgcaagaaaaatcgggcctgtctgggcgcttgtcacatccacatgccggatgcggtccacctctttatcctccctggtattctcatgcttcttcacgatctggttcagataatcgtccaccgaagaacaggccgtaatgccggtctgcgtatggccgttcatggtaagttcatagagataatagcagggaacctcctcagccacaaaaatccccttctcctccatctctttcagaacctccccggctttcacatagacgcgctcatcataggtatccacgtcatcgggaaaccaggtttccgctctgtcgatgctcagaaaggaaagcggctccttctccacctctctcttcgcttcctctctgttgtaaacatcatatggcagcgcagccaccctcgatgcggactctgcggcgggacgcacgcagtaaaacggttttatctcagccatttttattctcctccttctcatttctattcaaccaaaaacaccggggcggccgcttaggaaagcggccgctccggcgcaacctgcattcagccgggctgctgccgagccttcggcagagcggcagcaaattacctgattacacgaacacgcatcattcccttgatcgcattcagcttctggcgggtcaaatcatccagctcattttccaaatctatcagggtgtaagcgtatttctctttgctcttattcgtcatgttggcaatgttcatatcggtggcggccaggatggcagaaatctggccgatcatattcggtatattcatatgcagcagtgcaacacggtttaccgacgcgcacacacccatatcacagtccggatagttgaccgagttcttgatattgccgttgttaagataatccatcatctctttcaccgccataacggcgcagttatcctcagactcttccgtggaagcgcccagatgcgggatcacgatggcatgctccatagccgctgtctttacgttcgggaagtcggttacgtagcgtttaacctttccctccttcagggcctcggccatatcatcatcatttacaagcagatctcttgcgaagttcaggattaccacgccctccttcatatccgccatcgtcgtcttgttgatcatctgtctcgttccgtcaagaagcggaacgtggagcgttatgtaatcgcactctttatagattgtgtcggcagacatgatgtgcttcacatctctggaaagcatccaggcagcattgacggaaataaacggatcgtatccgtaaacctccattccaagtgaagccgccgcattggcaacctcggcgccaatagccccaaggccgattaccccaagctttttccctttgatttcatggccggcaaacgctttctttgccttctcgacatcttttgcaatattcgggttttctttttcttttttgcaccattcaataccgcctgcaatatcacgggatgacagtatcaggcccgcaattacaagttcttttacaccgtttgcattggcccccggcgtattgaacacgactatgccccgctcggcgcaggcgtccagcggaatgttgttcactccggcccctgcacgggcaactgcacggaggttctccgagaactccatctcatgcatggatgcgcttctaaccaggattccgtccgcctcagccgccgaatccactatctcatattcttctggaaacagtccggttccgagtttcgaaatcggattgaggcagtgtatctttcttcttttcatatccgttacatcctccgcttctcatcactttgcgtgctttttctcaaattcacgcataaattccaccagcgcttcaacgccttcgattggcattgcattataaatgctggctctcataccgcctacggtgcggtgtccctttaaattaacgaatccggctgcttttgcctccttgacaaacagggcatccagctcttcatctcccgtaacaaacggcacgttcatcagggaacggtctttcttctcaaccgtacctctaaacagacggctctcatccaggaaatcataaaggatcttcgccttcttctcgttgcgctccttcatcacttccagtccgcccattttcttcagccacttaaatactttgccgcacatataaatcgtataggtgggcggcgtgttgaaaagggaatcattgtccgcatatgtcttatagcgcagcatcgtaggcgtacccggaagtacatcctccgtaatcaggtcttcacggattattacgatggcgacaccggccggccctacattcttctgtacgccgccccataaaataccaaatttgcttacatcgatcggttctgagagaaaacatgaggagatatctgccaccagggtctttcccttggtgtttggaagttcatggtacacggtaccataaatggtattgttcaggcaaatgtaaacgtaatccgcattctcgtcaatcggcaaatcagagcaatccggtatgtagctgaaggtcctgtcggcgcttgacgccaccgcattggccgtaccgaacagctttgcttccgtatacgctttttttgcccactggcctgtgatgatatagtcgccgactttattcttcatcagattcatcgggaccatggcaaactgcacgtgtccgcctccctgtacaaataatactttgtagttgtcgggaatattcatcagttcgcgcagatctttttcagcttcgtcaataatatcctggaaatctttagatctgtggctcatctccatgacggacatcccacatcctttgtaatccagcatctcctcagccgcttctttcagtacttcttccggcagtacagccggacctgccgaaaaattgtagactctgctcatagatagttcctcctctttttcctcatatctcttctcatgatttgtaacagtccatgcagcatgaactgttaccattataaacatccgaaaattcggatgtttataataatgttttctattttacaactgttcaatccgtaagtcaatctcatcaaaggcttcttcgattggttttccagccggaaccatcgggaataccttgtcatctgtcccgatctgacagtcaattaccaccggaacattcagactgatggcctcgagcagagtcggctccacctcttcctttgtcgtgatgcggtatgcctttgcacccaggccttccgccacctttacgaagtctacctgatcattcaggttcgtctgggagtaccgcattccgtagaagagtgtctgccactggcgcaccattcccagcacatggttgttaaacacaatctggataatcggaatattatagcgggttgccgtggctatctcattcatattcatgcggaaacatccgtccccgccgatattgattaccagtttatccctgcatcccatcttagctccgatcgcggctccgagaccgtatcccatcgtgccaaggccgcccgatgtgagaagctgtctggggcgtttgtacttataatattgtgcagcccacatctgatgctggcctacatccgtcgtaatgattgcctccccttttgtcacctcataaatcttttccataatataaggcccggtcagcacttctttattataacgcagcggatacatatcctttaaacgctccacatgggcaatccactgatcatggttaatcggatcgaggcgggcattcagccttctgagtatcactttcacatcaccgatcacgctggcgtccgtctttatatttttattaatctcagccggatccacatccaactggagaatctttgcatgggacgcgaagcgggacgcatctcctacgacgcggtcactgaacctggctcctacaactatcagcagatcgcattccgccaccccgaaattagaggtctttgtaccgtgcatgccaatcattccggtatacagttcgtcggtcccgtcaaatgctccttttcccatcaggctgtctgcgaccggagcctggatcttgtgggcaaaagcgtgaagttcgtcggaggcctccgccgcaacggctcctccgcctacgaagataaacggctttttggaggaacggatcatgcccagggctttttccaggtcttcctctgtaatatcggaagactccctctttacctcctccggctttttatattcgtattcacactctgcggccgttacatccttcgtgatatcgacaaggaccgggccgggccggccgcttttggcgattgtgaacgcccttctcaaaactccggcaagctttgtcacatccttgacaataaagttgtattttgtgatcggcatcgtcacgccgagaatatcgatttcctgaaagctgtcttttccaagcaggttaacagccacattacaggtgatggccaccatcgggatggaatccaggtttgccgtcgcaattcccgtcacaaggttggtcgcgccgggtcctgaggtggcgaggcagactcccaccttgcccgttgccctggcatagccgtcggccgcatgggacgctccctgctcatgggaggtcaggatatgggtgatttcattctgatgtttataaagcgcatcataaatgtttaaaatagtgcctccgggatagccgaatacggtatccacttcctgctcttttaagcattcgatgacaatttctgctcctgttaatgtcttcatttatttccctctgctttcctgtgttatttgtaacaattcagccttgttatcgtttgttgcagtttggccgaaggcaaaactgtcgtgtttatttctttggaacctccagtacggcgcctctgttgccgctggtaaccatagacgcatatctggccagataaccggtcgtaacctgcggagttctcggctgccatttctttcttctctcttccatcacttcgtccgatacaagtacattgagggcattatgattgatatcgatggatatgatatccccctcctccacaagtccgatgggaccgcccacggccgcttcaggagatacgtgtccgatggaagctcccctggaagctcctgagaaacggccgtctgtgatcagggctacactggatccaagccccattcctgcaatcgccgatgtcggattcagcatctctctcatgccgggacctcccttcggaccttcatagcggatcacgaccacatctccggccacaatcttaccgcccttgatggccgcaattgcatcctcctcgcagtcaaatacgcgggccgggccttcatgctttaacatctccggcgctactgcggaacgtttgactaccgccgtgtcgggagccaggtttccttttaatacggcaatgccgccggtctcgctgtacgggttgtcgattggcctgatgacctccggatcccggttgatgcagtttgcgatattctcgcccactgtctttcccgtaacagtcaggcagtccagattcagcagatctttctttgccagctcgttcataactgcatacacgccgcctgcctcatttaaatcttccatataagtagggccggccggcgccaggtggcagaggttcggcgtttttacgctcatctcgttgaccagctccatattcagctccacaccagcctcatgggcaatcgccggcagatgcagcatgctgttggttgaacacccgagagccatatccacggtgagggcatttaaaaatgctttctccgtcatgatgtccctggggcggatattcttctcatacatctccattactttcatgccggcatgcttggccagctttattcgctccgaatatacggcgggaatggtaccgttgcccttcagtcccatgcctagcacttccgtcagacagttcatgctgttggccgtatacataccggagcaggaaccgcaggtcggacataccttgttctcaaattccgttacttcttcctccgtcatcgtcccggccgcataggaaccaaccgcttcgaacatgctggaaaggctcctcttctgcccgtggactcttccggccagcatcggtcctccgctgacgaatacggtcggcacattgacacgggccgccgccatcaaaagccccggcacattcttgtcacaatttggaaccatgacaagggcgtcaaactggtgggccagcgccatgcactccgtggaatcggcgatcaaatctctcgtcaccagtgaatacttcattcccagatgtcccatggcaattccgtcgcagactgctatggcaggaaataccaccggtgttccgcctgccatcgccactcccagcttgactgcctctacaatcttatcgagattcatatgtcccggaacaatttcattataggagctgacgattcccaccatcggctttctcatctcttcctcggtcattccaagtgcattaaataatgatctatggggtgcctgctgcatcccttttcttactgcatcacttttcatcttttctcgtctcctttttaagtctccgtccatttttcggtttatcttttattgtacagcatttccagcgatttttcacctgttttatatggctttttccatcttttttttcaaatcttacaagtatttcccgctttttccgaatttttgtaaagcggagtccggccggcctgatataagcaatatagtttgtctataatctgaatgatggagttttatgcaaaactccatcatttcttccatacacaatttctgtttttttcagcagataaactactcgcatgacaataataaatatatgtttactattgtcatgtgactatattaaatcttttatccggctttatatcgccttttcagccttttcgcggcctcaaactgcttaaatcgttacactgcacataacagttcaggcagcatgaactgttacctcggcacagctctgtcagcggattttctcacagatgagccttcccatctctgtcgttcccacctctttgcagccttctgccataatgtcaaccgtcctgtacccatccgacaggacctgctgcacggcagcttccacggcttttgattccctgtctaaatcaaaagaatagctgagcatcatagccgccgataaaatcgtggcgatagggttcgcaatatccttgccggcaatgtcgggcgcggaaccgtggcttggctcataaagtccaaatctgccttcgttcaggctggccgatgagagcattccgatggagcctgtgatcatgctggcctcatcggaaagaatatctccaaacatattctccgtcagaatcacgtcaaactgccccgggttcatgacgagctgcatcgcacagttatcaacgagcatatgggagagcgtaacctccggataatcctttgccacctcttccaccacttttctccagagcctggaagaatccagcacattggctttatcaacactcgtcacctgtctgcttctcttcatcgctatgtcaaaggccttaacggcgattcttctaatctcttcttcattatatacgagtgtgtccacagcctgaagcatgccgttcacttcctccgtatggcgttccccgaagtaaagtcctcccgtaagctccctcatgatgaccatgtcgaagccgtcaccgataatttctttcttcagagggcaggcgtccgcaagctctttatagagataggccggacgtatattggcaaaaagtccgagtcccttcctgatagccagcagcccggcctccggccgcagatttggcgccacgtcataccatctggaattgccgacgttgccgccgacagcgcccaacagcacagaatcgctctccctcgcagtctgaagcgcctcgtcggtgagcggtatcccgtgaacgtcgatggatgcgcctcccataagcacttttgtatattcaaatgtatggccgtaaatctctccaacacggtcaagcaccttgcatgcctctctcacgatctccggaccgataccatctcccggaatcactgcgattttataattcattttctcatcctcctgcttcgataaccattttatttgttaaataatccgattacatttaatcatagcttattcaattgcatttttcaacagtatgccgggatttcaccgttttccggcgtatagcaatttggaatttattctataacctcaggttatctggtttctcacatgaaaggataagacggacattttatcctgccgggctgctttaaactgccccgtttaacagaactccttcccggctcagttttattgattgcggtgacctgtgcgcagagcatgcaggtcatcatttaactgtcctgcgtctcccctctgctccccagcttgcaaatcccctgggtcatcgttcccatcggacagaaagtacaccagcttctcggtttatagagaaccatcataatcaggccaagtaagagtgatgtcagcatcaggctgtagaacccgaagctgtactgggccacccagtccggcaccattcctgcggtgtaagtccagccccatggaactttaaaggtccagaacagtttgatcgcctccctgagtcccgaagcccccgccgccacaagccaggtctgaaacaccatatttccgaacatagccatgaaaaaggccagaaaaccgtaacggaaccagggcgatacgagaaaccggggcgtcggcctgttcctggaacatttatattttccccccagcagcgcaaacaattggccgcggccgcagagattgttgcaaaaccacttatttctcccgaaaacagcgataaaaacaggcacaagaaaatcgatcattccaagccatgcaaataaaatattaaagaagcccagtgtaaaataaatgatggaccatatccagagatagtcataccagtgtttctttttcatagctgtgcctccctgataagaatcgagagcgcaccggccgggcacagcttttcacacagaccgcagccgacgcacttctccaaatccgcagccgcatagcagcctcctgataccgcgatcgcctccctggggcagaccttacagcatgctccgcacgcgacgcatcgttttaggttcaccgatacacttcgttttgttttaacagacatttctctaactcctttttgcttgatgtacaacagtatacaggatccttgaagatgattctgtaaccgggtcacattttaagagattccctgttgctaatctaatcttctttcggtacaatggaaaaacagggcatgcaacttaaagtagcagaaaaaatcctgtatgatacatcaggttggtggcagtggcgccgctgcaactgtagaataaatttataaaaatattctgcagaaggagaaaataatatgagtttttcagagaatttacaatacttaagaaaaaaacaaaatttgacacaggagcagtttgccgaacagatggaggtatcgagacaggccgtctccaaatgggaatcaggggattcacttagataaagataccacaccattcccacgctgacttttgctcaaccgatacagccggagggctggataacaagaaaaggcggtatgcgccccgtagaggggtagcgtaccgccttttcttgtgggggtttccaaagggggcaacgcccccatttggcacacgactttgcgaagcaaagtgtagtgtgttatacgctctgtcggcgttgccgtgaaaatgccgttgccgccggggaggggcggcaggaaaacaggactgtgcttgtgtggcgtggagccgcaagcgcaggtctgttttcatcagcagacagggcgtatatgaaagcccccgtccctcgtcctacgctccgacttgtggacaaagtgtcccgaagttgtggctacactcccggaaaagtaacaggacagcgggtaaccgtcaaggctgaaatgaacgggtttacacccggccttgaccgccacccgccgtcccactgaatgggtggacaaggcggccaatccctcaaagtgcttgtccgcgctctttctgattttgaggtattcagtttttcaaaattgaataatcaaaataaattttttcgattgaaaaaattttatttgttatcatcttcaatgccatattttttcttttgccgaatcacataattactgattttttcatcatatagtggatactggtaatccaactggcatgccacttctgacgaaacctcccggaacaatgccatacattgttcaaaggattcccacatatggggataggaatccatattataagtggacataagtcgttcccacaattcctctgggacatattgcttcataaatttatagttttttcccaaactgaaatgaaatccctgtttgataccaatcagccaggaaatcatgcgaagcaattcttttcgtactatatcattcatatggtcaatagcaaaaagaatttctttgcggcataagccctttactacatatgttgtagtattccaaaattcattacagcaatcgtcaaacattctttgagtaggcttctgcaagtggtagtctatatccgttggtattggcggctttacgatacggttgtctttatccaacagtaactttaccagtttatcccatgtaaaatactcgtctatcagttccagcggcagcaaagttaaatctatcttaacatcatcagtaaacagcattaaatatgaaaatcccttttctacagctggaaataattccatatcttccggcttttgcagaatcaacctttcaccaaatatatctagccatttatcatcacttgtgaagctgtccatatccgtaacaaaaaaagtaatatcaaaatcctgaaaatcatcaggcggaatatttgtatttgttctagatccttccaaagtaaccatgcgaatgcgtttgtctgtttttgcaaaattcaaaacaatatcataaacttccttttctgatctcatttttatctcctccaattattgaaataggtgtgaagccattttagggctttcccgccttgattgctcatcagcaaaggcgggcggggctgtcaacggcggcgcgtatgcgccgttcatcttgaccgttgactggctcggctggctttgctatcctccgataaattactatctggatttcatttctttttcaaatctaaagaaataattgttctcttttggtatgttgcctgcgctttcacttatttggtgtgggtctttgtgcttaggattaaaaaattctacaatcttgaaaccacaacgatttacataaaaatgaatgttccgcttatcgtaatatggggtatgcgtctcccaaattcttgtttcaggatgtagttcttcaatcgctttccatatcttaaatccatttccagcattttgtgcgcttgatttcacatataaaagatgaagtgagttgtagccggtcttatcatctattacaatgactgctccgccgattctttctccgccaatttctgcgatatatgcttcagcgccttttgcgttaaaagattcttctatatcttccgtgggaagaacttgcttttcaaattctccaaactctgacacataagaaatttgaaaagcctcttgtatttcacttacaaatgtgtttttttcttcaacggtaatgattggtcttaattttattgtgttcatacttccttgctctccttaaattttatagtctggttcatcaaagaagtatgtctttattctctcccaccccaatcaaatagtttcatagttcaccactccaaatctcgattttccgttctcctactttcttccccgctggggctttggatttttcagcaagtcagacttttgtgcaattctttttagccatttcttttcttcctcgaacagcttcttgtaattcagtttgagccgcttgcagataaacatcatagccgcctgctccgggtcgctgtcctctctggtggtttcctctgcggtctgcaagaaatcttccagtgggttgtcctctgggacactgaaaaaatcgtccttatgggcttcccgcaggtcgagggctatcttgtttatgtcctgctgtatcacatagcggcaaaagctgtcgtcgtcaatatgggcggcgataagctgtcgcagctgcgggtcagtcaagccgggattgtgttgtttcataattgttgcactcacagcgtccacaatggcgtttgcgctctgcacctgttttcctgccacgccgttcacatagatttcaaggtcggccatgagccggggaaaatccgggtgggtcgccagttcacacaaaagagaattgtccaccagcccgctttttaatagttcaatcatgtcatcactcaaatgcaggtctgcaagatcggcgtttgggtgatttcttgtttgagaacggcccagcagataatcaacggtcacttcgtaaaactttgccaactcaataagggcataatggctgatgtccttgagattgtccccctcataactgcctaaagcagacttggagaggtgggtctgctccgcaagctgttccagcgtcagcccacgctctacacgcaggtctttcaatcgttcttgtatggatagttccatgctctcctcctcatccgcttaagcggccgatatttattttgtgagagtaataagttcatcaactgattggaagccgtttttcttataaaatttttcggccggaaaacctcgttcagtattcaaaatgattgcgttcattttttcgataaagtccgtataattgtgtaaaagtaaaaaggccatataacagtccttttacggtacaatgtttttaacgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtagaaatggtaaaaacattgtatagcattttacacaggagtctggacttgactcacttcctttattatttttcatttttttaaactatttaatactaatgtcttttataatagcttttcatatattatataatcaatctttataagtccttttataaatttcttttctaccattttcgataaattcctgtttaatatttttaattccataaacaatagtttcaataggataatattcttcaactatatcttgatattcttttgctttctcaatatctatatttccatacattcttaatatatcttctccaaaatttgttcctatttcttcttcactatcttcaagtaagtatataaaatcacaatattcatctataattccagaatctccaaaatcaattattccagttaatctattattgccatctaacaatagatgattacaactaaaatcattatggcataaacactttttaccctcaaaaactgttgttgcatttagtctttccataaaactttctatataatctttttctatatcagttaaatcattataaatagtttcacgcaacaatatatactcttctaatacattttgtttattatcaatagtacattcactaatatctgtataatctaaaccgtgcatttgtcttaaaaaactggcaatatctcgttttaacaaattttgttcttcttctgacatagtagaataaatttctggtgttaaaaaagttcctttaatttctttataacctagtatagataattcatcactaatatacgaatattcaatattaggaatttttacattagtttctaaatttgtatttaaaaaattatatattgctttttcttttgcataaccttttttcttattagtactaaattttgttttaaaaatgtattcattattaactaaatatgccacactatcataaccactaccgattatttcaatactatctactttgaaattatcaaagtaatgctcaattaaatatttcattgccttaacatttgtggcattatcatcatatctatattccattaaataacaatcttcttttttgccctcgtgtaattcatgttctggcaaatcttcaataattctaaaaccagatttttggtatgcccttattgctcttggattatttttatgagggtctaaaataactgcattagcatttctttcttttttcaaaaattcaaaaatcaatttaatatatcttgtaccaattcctttactccaataatttggctctcctataaattgatccataccatagactatctcatcagtttttggataatgataatcagtatataactcatcatacattttatatatttgtccatatccaataggaacattgttatattcaataattactctaaaaacttcatcttcccaaggctctgtataatgtttttttaatgattctaatgtatattttttatctctaccaccataaaattctaatactctttcatcagttaaccattttaacatcaaaggaaaatcatcatctattaaagttcttatacatatttcattttcaactatattcatttatttatcacctttttcataatcatatacatatactatttcatctttataatcatttttaccacctaatttttcatatacatggcaagctctaggattacctttatcagttattaaaaacatttcagaacaaccaatctctttagaatattccttaataaaagataataattttgaaccataacctttgtcttgatagttaggtaacattcctattgagtgtaaataaaacattgtttttccatcaggtcttaaaagtgtatagcaatatgcaaatcctataattttattattttctttagctataaacccaaatgaactggtatcattaagaaatccttttaaattatcaatatcaaaaaccatattatcatcaattaaaacttcttccataaactcagtcaagtccagactcctgtgtaaaatgctatacaatgtttttaccatttctacttatcaaaattgatgtattttcttgaagaataaatccattcatcatgtaggtccataagaacggctccaattaagcgattggctgatgtttgattggggaagatgcgaataatcttttctcttctgcgtacttcttgattcagtcgttcaattagattggtactctttagtcgattgtgggaatttccttgtacggtatattgaaaggcgtcttcgaatccatcatccaatgatgcgcaagcttttgaatattttggttgatcgatataatcatgaatcaatcgatttttagcctcacgcgctaagttaatatctgtgaacttaaaaattcctttaacagcttctctgaaagattttgaattttttttaggaatggtggtaaagatatttcttaggaagtgaacttggcatctttgccaacttacgttggtgaaggattttctaatggcagagactaatcctttgtgcgcatcagaaataacgagttccgtaccttgtaaaccgcgttcttttaggtattcaaaaaatgttgtccaggtctcttcgctttcgccactttgaatcatgaagccgataatttcacggtcgccatctttggttattccaatcgctatatgacagctttttgagagtactcgattttcttctcgtacttttatatagagtacatcggtcattaagtaaggataatttttttctgataataaacgattctgccactcgttaaccataggttctagctgttctgttaagctagaaacgaaggacttagagacggatttaccacaaagttcttccacaatttttgatactttacgagttgaaacgcctgatacatacatttccaacattgaagccatgagggctttttcgtttcgttgataacgttcaaacactgtgggtgaaaaatggccatcacgtgttctgggtacttttaattctagcgtgcctacacgtgtcgtaaagctgcgctcataatagccatttcgttgactttgtcggttttctgttcgttcatattcttttgcttgaatatattctgttcgttgattttccattagttgattaaataccgttgttaaaatatttttagaaacgtcatcctttacagaatattcaataatgctttgaatctcttcgcttttcagtgtaaaatgtacttgggtcatgtaaaagtcctcctgggtatgtttttgtcgttaaaaacattgtaccgtaaaaggactgttatatggcctttttacttttacacaattatacggactttatcattttttctgtctgtatctcattttcaatcaatttcaaaaaataacttccaatccctttcccttgcaagtcagtctttacacaaaactggtcgatataatattccattccgttaatccatggtttcttcattcccacgctgatagcaatcatacagttttggtcttttaagccataccctacaaagtagttattgtttatgtagttttgaaaataacttatcacctgccctttggaattgtatgtatcattccagggggcttttgtgaacacatcaataaataaatctgcacattcctcaatgtgctcctttgacagtctaattatgttcaaaaattctcctccctcatattttcttccattataccacaattccgagagcgtggaaatagggagttttccgggcggatttcctacctcttggatatacgggacgggcggttatttaggtgtagacttaggatagttcatcgatggacagcaccttgaaaacagaatgaccgtccgaaaaggaataccccggctggggaagcaccgcaaggaaccggacttcgggacaaaatgtcccgaagctgcggggagcgtgccaaagctggaaatcctttcggggaaaacggcaacggaaagcaaaatggagggaacgcatgagaaataacccctataaagacttgccgccgctggaacgcaggccggacggttccctttaccgcatgacaccggcacagaggaaacaggcggccagcctgatacgccgggagtgctgttgctgtgaggacggcaactgcattgtccttgacgatggggacacctgcacctgcccgcagacggtttctttctcggtctgctgtaagtggttccgctgggcggtcttgccgctggacgggacgctggaagcggagattttccgggataaggacttgaaacgctgtgtggtctgcggcggtgtgttcgtccccaaatccaaccgggcaaaatactgccccggctgtgccgccagagttcacaggcggcagaaaacagaaagtgaacggaaaaggaggtctgctgtggacagttaggagcgaaaaaagccttgatttatcaggctttgcaagccccaaaccggggcaggtggtataaagtatcgcccgccccggaaaacgggcttctaaccgtccacaaaacgcactatgacaaataccatctatatccatcagccggaaaaggcgttcagcttcacccggctcccgaatttcctctttgaagcccccacattcaagcccctgtccaacgaggcaaaggttctgtacgcctttatcctgcgccggacagagttgtcccgcaagaatgggtgggcggatgactgcggacggattttcctgtattaccccatctgcgaggtggttgacctgctccactgtgggcggcagaaagcggtgaacaccctgcgggaactgcaatacgccggactggtggaaatccagaagcagggctgtggaaaacccaaccgcattttcccaaaatcctatgaagcggttccaaacactgacttcaagaaatcccgttctggtacgccggaggactgaaaaccgtacccatgaagtacggaaaccgcccctcttgaagtacgaaaaccggacggtatatagaaatacaaagattaaaatgatttatttatatccattccattcctatcgtatcagagataattccggcgggattttccctgtggaaaaccccggataggaaaggaatggggaaaggagcagaatggcacaacacgcaattttgcggtttgagaagcacaagggcaacccggcaaggccgctggaagcccatcacgaaagacagaaagaacaatacgccagcaaccccgacattgacacaagccggagtaaatacaacttccatatcgtcaagccggagggacgctattaccacttcattcagagccgtatcgagcaggctggatgccggacgaggaaagacagcacacggtttgtcgatacgctgataaccgccagcccggagttcttcaaggggaaatccccaaaagagatacaggcgttcttccaaagggcggcagatttcctcattggccgggtaggacgggaaaatatcgtgtcggcggtggtacacatggacgagaaaacgccccacctgcatttgacctttgttccgctgacaaaggacaaccgcctgtgcgctaaggagattatcggcaaccgggcaaacctgacgaagtggcaggacgattttcacgcctatatggtggagaaatatcccgacttggagcgtggggaaagtgccagcaagacaggccggaagcatatccccacccggattttcaaacaggcggtttccctctcccggcaggcaagagccattgaagccgcccttgacggcattaacccgctgaacgccggaaagaaaaaagaggaagccctctccatgctgaaaaagtggttcccgcagatggagaacttctccgggcaactgaaaaagtacaaggtcacaatcaatgacctgttggcggagaatgagaagctggaagcaagggcaaaggccagcgaaaaaggaaagatgaaagatacgatggaacgggcaaagctgaaaagcgaactggacaatttacagcggctggttgaccgtatcccgccggatatactggcggaactgaaacggcagcagcggcacacggtaaaggaaaggtgatagatataagcagaaattttcgccgcctttgtgcggcattgtaccttgaaaactgaatatggaggacactggatggcaaaaagcgaaagcgatattttcacaccccggacagggcaggtcatacaagcagagaacggcacgcagtattttgtatgtgggaacaaccgtataaaaatctccgaacacttcgccgcaggcgggaagcccctcggtgatctgattgtagatgtggtgcggcataccgcagaaaaagccgcttcaacctgatagcccatcattgataacacgcccacgcttatgatataattgccatagagcaaaagtattgtaagcgtgggttgtttctttagaaggaggatttttaacggtgaaacaaccttacaatactacgatttacaacacggcgctttatatgagattgagccgggacgatgaaaactatggtgacagcgtaagcattgaaacacagcggacaatcctgcaacagtacgcaaaggaacaggggcttcatgtagtcggtgagtatgtggacgatggctggtcggggacgaactttgaacggccggattttcagcgcatgatggacgatatggaagccggaaaagtaaactgcattgtcacgaaagacctgtcccgtttcgggcgggaacatgtgatgatggactactatctggaatttctgttcccggagaaacgggttcgctacatcgccgttgcggagaatgaggacacagagaaagggctttccgattttgtcccgttcaaaaacctgttcaatgaatggtttgcgaaagatacaagccgcaaggtaaaggccgctttcaaagcaaagtttgccacaggacagcgtatcggcgcctatgctcccatcgggtacaggaaacacccggaaatcaaaaacaagctgataatcgacgaggaaacccgctggatagtggagaagatttttgaccttgctattcatggcagaggggcggccagtatcacaagaatactgattgcggaaaaggttcccacaccgggatttatcaacttccagcgtgacgggacttttgcaaacatctatgcgggtgcgccggaggaaaaaagctacgcatggacgatagcccaggtcaagagcattatgaaagacgaaacctatatcggccataccattcattaccgggaaacgaacatttcctttaagaacaagcggagggtacgcaagccccaaagtgaatgggtgcgggtggagaacacgcaggagccgattatcagcgagcaggttttccggcaggtacaggagcagatagcaaaccgccgcaggaagtgcaaggatggtacaacgcagattttttccggattggtaaaatgtgcggattgcggctggtcgctgtcctatggggagaacaggcagaacagcaagccttacggccattatcattgtagcaagtacgggcagggcacacgccaatgctccatgcactatatccgttatgatgtgctttatgcctatgtcctctcccgtctgcaatactggtcggggctggtacagcatgatgaagaacggctcttgaagcagctgttaaatgccactgataagggacaggctgccgcaagaaagaagcaggccgcagaactgaaaaaggcagagaagcgaaaagccgaagtcgatactttgtttgcccggatgtatgaggactgggcggcggggcgtatcacggaatacaacttctctatgctgtccgggaagtaccaaagcgaacaggctgaactggacgaaaagattgaacagcttcaatccgctatcgccactgaaagccagaacgccgtagacgcagaaaaatggattgccttgatgaaagagtgcgtcaatccaacagaactgaccgccgaacttttgaatatgctgattgaaaaaatcgttgtccatgaagcggtcaaaggtgaggacggaagccgggaacaggaggtagaaatcttctaccgctttatcggcaaaattgattgaatgataccaatatctttaactatgtgataccggccagtcttacccggagatggaaaaactgcttcagatatgcgagcagttcggatgttccatggacagcctcatcaaaggcgatgtgacagaagcggcaaaagaagattcgacaggctataaccgccatatgaaccgctattccatcatggtttcctctgccgttgccctgatcattttttcggtcgcaatcatcgcctcgctggacggaatcgtaagcgaagccgttacaagcattatcctgttcgtattgatcggaattgccgtatatatcctgataatagccggcatcagccatcagtactaccgcaggcgctatcccgatatcgataatttctacacggaagaacagcatgccaatttcaaccgtatttttgcaattgccatagcttccggggtcagtctcattgttttttctctctacctgaacatctggcttgagtacaccgttatcccttattctgagcagataagcggaggcgtttttcttctctgtaccgccgtggccgtcggtattttcactttctttggcatgcagaaggacaaatacgacatcggcaaatataaccaggaaaaccgtccggaggttcccggcaaaaagcacctggcgagcaagctgtgcggcgtcatcatgctcctggcgacagctctcttcctgttcctcggcctttcatttgatatgttccggtccgcagccgtcatttatccggtcgcaggaatcttctgcggtatcgtctgcctgctgctgagcgataaatagctgtgccgtctggagcgcggcattaagaaacggcctgtaaatacagctcggacagatgcggtaaaccgctgtcccgtctgcatttacaggccgtttcctcttctttcgcgttactttttttctaagaccgtcttttttctgatcttcagcaacaacagaatcatgctgattcccagcataatatggcccacaccggaaaggcccgatatggaagcatccatacccctgctgagttcggtaccccatacctgtgtcagaccccttaaaagaaaaccgagggcggtgacattcaaacctatgtgatagactgtcagaattattccaatcttctccccgccggaaaaccggaaattcttttcaagcagcatcagtatgagaaagaaaaacattcccaacagaaaataatgtgtatgcatgacagataaattagtttttccggtaaaaccgttaaattttgtaaactccctgtaaaacacaccgaataccatggcagtcgctgcatagaatatggctgcatccgcataacgtttttccattttatctcctccgttctatgtatgcctgattattatttcttctttgtaaagccgtctcgccatccaaatcatccagacgtaagccagtgtctttggaatcatcagcatgcccacggccggtactgcgccgctgaacaatacgacgggcaggtagaaaccaaaggaaagtcccgccgccaaaggcataaaccggaacaccggatccgcttttttcccggcctctgcggcaaagattacgataatgataattcccattatcgcaaatgggatatttcgcagtatcccgtaagacagaggctggtgataggacagccactcgttctgaggcagaagacaaagtccaatcctcaggcatgctaaaaaccacattacaccggtaagtgtcttacgttcccgaatctggtaacgctcacgccagatataatataaaatcagataaaaaaccgtcatcgtgacagacgtaataaatttcccaatccccaatgcggctgcatttgcttccatccctgttgtccaaagtgcataggaacgcggtaccagatgaaaggaatcccctgcccccagcagcgccgtcatccatcctgccatttttacgatccggctctttccttttgtcagcatggtcagtcctgttatcagggcaaaaccaagatataaaatgtcaaaaactgtttcagcaatcgcctgtgccatagccgtactcctctctgtctcaataaatggtccgtttgactatttccagaaaaaaccggaaatcatatggatgctccctgagcagcagcatcatattcgccataataaaacgggcataatctctctttgtaaatgtttcgtcccagatatcactgcgtatgcccggatcctgctccatccgatacaccattgcggcttccagaacctcctgcatggattccattctctcctgccctgtctccctgacattcccgaggctgtgcatcagcattccggcggagctgtcgatacgctcccgtaaaaaagtaaaaatttcctccagctgcccgcagaatgagggggccgtgactgccgccctcatatcggccaaggtctttctccagtattcttccgtgagagccaggaggatttcgtctttacatgaaaaataattatataccgtacccgtcgcaatcccggctttcccggccagagagcgtatattgactgcctcaggcccctctttctccgccagttcccgggcatagtcaatcagtgcccccctcaggctgtcgtcttttttccgcaccgtatcatcccctttttcatttaaatgaacatgttcatatatactatacatttttttatctttcttgtcaacccttttatgaacacgttcataaaagatgacctgcacggttactattcacggcccatattccgcgcacaggtcaccgccttcaatatagagaaaaaagccgcccggattcattaatccagacggcttttttattatcggcaatgtttcatttcattgcccgtcactcatattaattacagttccggtttctcaacctgaacaattgcatccttgcgcataggaatacggcagttcttgttgctgccgaattctacgataaccgtatcatctgtcatgtcgatgattacgccgtaaaatccactggatgttaaaacgctgtcgcctactgcgacacctgccatcagctcctgcatttttttcttttccttctgctgtggtctgatcgcaataaagtacataagtcctatgataaagacaaaatatagtacccagcccgctgtgcccatgttctttcctcctttgaccgatccgccgcctcgccgcgtaatcttgatttttagtttgtcccggatggaacgcagtttggaccatgtccttattttgcttcctctccggccatcatgccggcaagctttgcagccttatattcggcataacggtgatgttcgattgcgtcgcgaatctcttccatcattttattataaaaatataaattatgcaatacacataatcgcatcccgagcatttcttttgccttaaacagatgtcttatataggccctgctgtaggaacggcatgccgggcagccgcagccctcttcaatcggctttttatccagttcatattttgcattcagcagattcatcttgccatggtttgtatagacatggctgtgccggccgtttctggtcggatacacgcagtcaaagaaatcaacgccgcggtccaccgcctctaaaatattggcaggcgttccgacccccatcaggtacgtaggcttatcctccggaagatggggaaccaccgcatcgaggatacggtacatctcctcatgggtttcacccacggccaggccgcccacagcatagccgtccagctccatcttgctgatggtctttgcatgcccgatgcggatatcctcgtaaattgctccctgattgattccaaagaggagctgctcacggttcaccgtatccggctgagcattcaggcgtttcatctcttcccggcagcgttcaagccatcttgtggttctgtctaccgaggcctggacgtattcccttgaagccacgctggacggacattcatcaaatgccattgcgattgtggagcccagattggactggatctgcatgctctcctccggacccatgaatatcttcctgccgtcgatatgggagttaaaataaacgccctcttcctttatctttcgaagtcccgacagggaaaatacctgaaaaccgccggaatccgtcagaatcggcctgtcccagttcatgaatttatgaagtccgccaaactgcttaatcagcttgtcaccggttctcacgtgcagatggtaggtgttggacaactctacctgtgttccgatttccttcagatcgtcggtagatacggctccctttatcgcccccacagttcccacattcatgaaaacaggtgtctggacagttccatggacggttttcatctctgcccgtttcgcgcgtccgtctttgtaaagaatcttatactccatatattatttctctttctttgtctttgccgcccgctctccggccgccttctgttcttttttctgattgaaaaggtaccacatggagccggtcaggcatacggaagaataagtaccgcagacaatacccaccatcagaggaagtgcaaactcgcggatggaagatactcccatcaggaagagaacaaataccatgataaatgttgtcagggaggtattgatacttctcgtcagcgtctggctgatacttaaattcacaacatcctccaccgtctgtgtatgctttttcagcttcatattctcacggatacggtcgaatataacaatggtggcattgatggaataaccgacaatcgtcagcatacatgcgataaacgtggaacccacggaccatttaaatacggcgtagaacgtcacgacaacgagtacgtcatgcaccagcgccagaaccgcacttgccgcaaacgtaatattgctgaaccggaaccagatataaagcagcatacagattgtagcaatcactacggcaatcaccgcatcctgtttcatctccttgctgattgcaccggagatactgtccgccgtgatcttttcctgatcaacgccaaaggtatcaaccagagccttatccagctcttctctctcgtccacgctcagagtcctggtcttaatgattacctcattggttccggctaccttctgtgtctgagttcccgcttcccctgttatcttctccacaacaggcactacctccgaagaaatccggtcaagtgacatatcctcattaaacgttacgtttgtcgatgtaccgcctctgaactccatactgtagttcaaaattgagccgccggaagcgctgttcattcccatcgccgcaaatccggcaagaatcaaaacacccgaaaccgcgaagcacagctttctgtatctcaggaacggccttacctttgtatccttcttaacgccatagtatttggcatcctgcaaacctgcctcaaacagacagtagagagcaaatttcgttacgaacagagccgtaaacatggaaaggatgataccaatcgccagtgtggacgcaaaaccttttaccgtaccggagcctctccagaaaagaacggctgccgcaatcagcgttgtaacgtttccgtcgatgatggcagacagagcctttgcaaaacctgtcttaatcgcagatttcactgtcttgcccattccgatttcttctttgatacgggtaaagataataacgttggcatccacggccataccgatggataagataatacctgcaacgcccggcagagttaatgttacctcaaaggctgccagcagcacaagaatcagtcccacataaaggcagagtgcgatagatgctgcaaggcccggaatcaggtatgcaaaaatcataaatacaacaacgatgccgaaaccgatggcgcctgccttcaggctggtggaaatcgcttcctggccaagctttgcgcctacgacgttagaacgcagctcttccagttccaatgaaagggagccgattcggattgtggcagccaggttctccgcctcttcaaagctgcccatgccgtcgatacggcactgtccgcctgtaatcggttcttttacattcggagccgaaattggctggccgtcatatacaatataaatgggcttgccgacccctttggtagtcgcatcggcaaacgcttttgtaccttcttcattaaaggtcaaggcaaccacatattccttcactccgctgctgtcgtccatgccggccttggcgctgctcacctgtttaccgtccaggacttgattgaactcagaatcaaggaatacaagggagccgggtttgcccagttcctgcaaaatcgcgttcgcatcggaaacgcctggaatatctacattgatacggttgctgccttcctggtaaacttccgcctcggtgctgtaattctgcaccctctgctgcagcttataaatcgtatccgccatgtcctcagaagacggatttgcctcttttgcctggtaggtaatgctgactccgccggccagatccaggcccagcttgattgctcccattgtcgaatatccgaaataaccgaaaataccgacagcaacaagcaggagcagcagccctatgaggctctttccttttttgttcttcatcgcttttctccttttgcttttatctatgcttacatctgtgcttacttttcagtgttattgttattattcttcctcagccagagcagctttaatcataattgcacactcgatccgctttttctgcatttcacatccgatatcataagcatctgtaatagagccatggaaattaaaagaattggccgcacagccgccgctgcagtaaaatctcgcaaaacaatccctgcatttatcctttgcgtagacattacagagcttgaattcattacaaatctccgtctttgtcacaccctcgtccacattaccgagaagaaattcttcatttcccacaaactgatgacaggggtagagatctccccatggcgttacagccaggtattcggttcctgaaccgcagccggataaccgcttcgcaacgcacggcccctggttcaagtccagcataaaatggaaaaaggtaaagccccttccctctttgtggcgctttatatattcctcagccagcctgtcgtactcctccatgatctgcggaaggtcttcttcccggatggcatagggttcctccggagaggccaccacaggctccaccgacatcttctcaaatccaagatcggcaaaatggagcacatcgtctgcaaagtccaggttatttctcgtaaaggtcccccggacaaagtaatccctgtcaccgcgttctttggcaaatttctggaacttcggcactatcaggtcatagcttcccctgccgttgcggaacggacgcatccggtcattgacgtcctgtctgccgtcaaggcttaaaactacgttgctcatctccctgttgctaaattccataatctcgtcgtttaaaagtacgccgttggttgtcagcgtaaaacggaacttcttattatgaagctcttcctgggaacgaccgtattccacaagctgctttaccacttcccagttcataagcggctctccgccgaaaaaatccacttccaggtttcttcgggcgcccgaatttgcgatcagaaaatccagcgcttttttaccgacctcatagctcatcagcgccctgcgtccgtggtactccccctcttccgcaaaacaataacggcaggccaggttacagtcatgggcaatgtgcagacagagcgcttttacaacagtctgcctctttttaaaatccatcacgtagtctttgtaaatatcggcggtaaaaagctcctccctgtcaattaattcctgtatgtcggaaaaagcttcctgaatctcatccgcactgtatttctccttcaggagctccgccacttcctccgcggtctttcgcggtacgggtgcaggctctttcatatcggcaagcctgcccgagagaagcttaattgcatcataaaggagcggatccaccgaatggacagaaccgctgttaacgtctaaaacgatataaaaaccgttatttatatattgatgaatcacaagattttctccttatccagacacatgtaggcagacaacaccgatccctcaagtcatgtaagtgaccgcaggggcccgtcttgcctgccttccttgtcaaatctcttatgttggctgacgatgaaaagcatgcttcccaacgttttcataaaattatcggttctgattctcgcagctctggtttcctactgtacaagatgtcttacatgcagactggcaggatgtctggcactcgccgcagccgcccttcttcatgctgttttttaatgtgtttgtgtttaatgttttaacgtgtttcatcgttctatatcctcctcattaaaattacgatataaattcttacagattatatcacatgttactcacatgtgcaagctaaaagccttgttatggagatttaactgaggttggaggacgcgtccggaacggaccatgtccggtgtggtgagggggatgcctgagtcttccgtccccgtgggaagttggttgtggagggggaatccggccggaatgaattgctgcggggaacgtttacactctttggagtgcgcagcagtgctaagctcgtaaaggacctcgccaagcaccggcggactcccatgtcccctccgcaattgattccgcctacttcccctgggcaggttatcgccggggacggaagactcaggcggaggttttcgcggcaccggacatggtccgttccgggcgctgattgtctctaaccttaaatggggaggaccctgtcgcggccactacgtgtttccgactggctgatatcaaatcttccactattttttaataaaggcgcattgaaggcttatcgtatttcccgcacacggaagcgctgagtggccgcgacaaggtccgcccccgcacttaacgcgtgaggcattcagcggccgcaggccagcggacggggccgatacacccggcggagtctttcgttccggcgaaaaccttccgggagaaggagatactgccgacatcttccggcggagccggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtagccccgggggctttgccttcctctgtcttagagctatccctcgaagaagcagtccagccggatatcattctctccggctccgccctgcgaaaacaaaaccatagtatctccttctccagccagcgatgcccccccccccgggacgaaagactcatatacacaccccaccaccccgtccgctggccgtaccggcggcgtcctcacctgcttaactaaatctccatttacggctgtccgcatatcctggccctctcatgaatatacatgaagcagaagaaaatttacaaggagtcattatgggaaagtccagtctgcggataataatccgcaccatttttatcacctacatactcaccgccatctttctgctgcttctggcattcggcctttatcagcttcatttgagtgaaagtcaggtaaatctggggatcaatgttatctacattgtcacctgttttatcggcggggttctggctggtaaagcagcaaaagtaaagcggtttttgtggggatttttctccggtacggcttactttctggtactcctggccgtttcttttttaatccacaagagtatcggaagcaatatgaatgaactggccctcatctttgccatgtgcgccggaagcggcacgataggcggaatgataagctgatcgtattttcatattcctgcggacagtcgcaaagatatgcaaacagccagacttcaataagtctggctgtaacatgttcaaacgatgcagtattttcttaaattctactgtttttccgcctcttcctcccgcctcgccgtaaccgcctcgatgggattgagaatatagagatgtatcttatcaatcctgtttttctctacgctgtcgacgcagagacgcacattatcaatcaccacgtcctcgccttcctcaggcaggtgatcgaggagtccgattaccagaccgccgatggaatcataatcctccgactgaagattcagttccagatagtcattcaaatctgtcagcttcatggagccttccaccacatattccctggggccaatctggataagcgcctcttcctcatcttcatcgtactcatcacggatttccccgacaatctcctccagcatgtcctccagcgtgataagtcccgccgtcgctccgtattcgtccaggacaatgacaatatttatcatggctttacgcatctcaatcatcagttccgaaacttttttgaactcatacgtgtagagcggctggcgcaggtaattcttcactgaaaaatcctcgctgttttccgccaggaagatatccttaatattgataatgccgatcacattgtctgtcgtctcttcaaataccggaaatctcgtgtacttctcttcccggaatatgtcaaccaaatcctgatagcttgtattcacatccacaaagctcatatcaatacggggaaccatgacgtcctttgccacggcatcaccgaaatcaaacacattgttgatcatcttcttctcttccgactcaatcacaccttcttcatggctgacctggacaatggtcctcagttcatcctccgtgatagactcccctctcctattcggatcaacccggaacaatttgaggacaaaaaaagatagatggtttacgatgtaaatcaccggtgtcaaaactatcattataatatatataatttttgcaaagcgaagagcgatgctctctgctgatattgtggaaaccgtcttcggcgtaatctcgccgaatacaaggataagcaatgtcagcacacccgtcgcaaaacccacggcctcgttgccccacaaccttgtagccagcattgtggaaagggatgatgcgtaaaggtttactatgttattgccaataagaatcgcactcagcatcttgcccggattgctgatcactttcatgacaaactcggccctgccatcaccggcatcggccagagtcctcatacggatcttgttcaccgtggtaagggctgtctctgacgatgagaaaaatgcagataatgcaagcaaaacaactaaaataagcaactgtatggcgtcacttgaatccaaaaaaatcaactcctgttttatcatattttaaagctgattctacaatatttcccactgcctgtcaacaaataataggaaagcttgctaaaaatcccgcctctgtttataataaagctattattagagaacacggaaggaaaaattatgaaagctacaatcggtattgatatcggcggttccacgacaaaaatagcaggatttactgaagaaaaaaagctcctcggcacactgcaggtcaaagcatcggatcagataaccagcctgtacggcgctctcggccgttttctgcgtgaacacgggctgtctctggccgatatttctaaaatcgtcctcaccggtgtgggcgcctcctttatcgaggaagatatctatgcaatcccaaccgtcaaagcagtggaactggatgccatcgcacgcggcggactggctctggccggtctggatgaagcattggttgtaagcatcggtaccggcaccgcttttgtgcgggcggacaaaaacagtatccgccatatagggggaagcggggtcggcggcggaaccctgtccggactggcctcccattttcttcatgaaaccgacattttcgtcctgtcctccatggctgagaaaggtgatctcagaaaggtggatctgatgatgagtgatatcttctgcggcgatattgcttcactgcccccggaactgaccgccgccaactttggaaaagttaaaaatgacgccagcgactgtgatgtcgccgccgccctctttaacctcgtgtaccagaccgtaggcgtcctggctatttttgccctgactaacgatacggccagagacattgtcctgaccggctctctcgcctgcctgcctccggcggtcaaggtattcggtgtgtttgagcaaatgaaagagctctacggcgtacacttcatcataccgccgaatgccgcattcgccacggcaatcggcgccgttatgatgaattttgatgattaggtattactgctccacagctccatccgctttatctgccctgtgttccgactttcttccgggcctgctctccgggccggagaaaagttcggaaacagccagcagaaaagtaccaagaaagatacaaatatcgccgatattgaataccacctttttaagccagccgaactgaaagctgaaataatccacgacgtaaccgcgtttcaccctgtcaaaaagattgctcagcgcacctgccgtcaccagggaaaatcccagtttgtcgatcagacggctttttctagtaagaagccagaaaaaaacacccgtcacagcagacgtaaaaaccagaggaaccgttttcaccagttcctggttgttttttaagaggccaaagcagaaaccgtcattatgatttctgtaaagccttatcttaccggaggttccttccatatccctggggaaatcttccttatcgccggcctctattttcccctttaaaagtatgtcaaggccgaacaggcctgccattaatccgagaaactgcataatcttcctcccatcctgctcataaataaattagacttcttcttcctatcgtatcatttttttgcattcccgtaaagtttcccaagacagctttccttataatattttctcccgcccggcatatattaataaaaacaatttaaggaaattgcgcatggcgtgtactgaaaattccgcttctgaatcatttgccgattttatttaccgatattatgtattctcacctgaatcaattctgcaggacatagatttttgttatgattttgtcaatccgcaatttattgttgtttaccagccgctctctgaagtggagccgctttctataggaaaagacggatatgatacaattcccagcctctatactttgctggattctgccaatatggacagcgccggcattttaagaactttcgaccagccccaattgggctataaaggcagcggcaccctgattggcattgtagataccggtattgattaccagaatcctgtttttaaaaatatggatggttccactagaattgtcggaatctgggatcagactattgagggccagggaattgagacgggagatatcgtacaggatatccgctatggaacctcctatacggaggaacagattaatgaggccttaaatagcgtggagccgctttccatcgtcccctctgtcgatacgattggtcacggcacttttatggcaatggttgccgctgggaatgaagtgccggcctccaatttcacgggtgccgcccccgaatcgaaattggcggttgtaaaactgaaaccggccaaaaaatatctcagggatttttatatggtttctgaagatgcgcatgcttaccaggaaaatgatatcatgctgggcattaaatatcttctactgatggcccggaaatactctctgccccttaccatcctgctgggtatcggtacgaataccggtagccacagcggctcttcgcctctgccgagttatctcaatcatttcagcaacagcttcggcctgataaccgtagtggccgggggcaacgaaaccggatttggccaccattatcttggccacattgccgcagaggaggagtatgaggaagttgagctgcgggtaggaagcaatgaaaccggattcacgatggagctgtgggccagggagtccgaactctattccgtcgcctttacctcgcccacaggggaactgatcccccgggtccccaatacctctccggaggagcaccgcctcaccttccttttggaagataccgttatctacttaagctacagcggtgctgaaagcgcgacgggcagccagcttatcatgatgcgcttcaagaatcccactcccggcatctggaaaatcagagtgcataatgaattgtttatacagggagaatataatatctggctccccacggccggtcttatatccgagaatacatttttcctgcgtcccgatccgaatacgattataacggaacccggaaacacagccggagccatcacggttgccgcttataaccaccgcaataacagtatttacatccattcaagcaggggctacacaagactcggcacaatcaaaccggatctggctgcccccggggtcaacgtcgtggctcccgataaccgtgcggaaaccggaacctccattgcagccgcccatgtggccggagcggcagccaacctgctatcctgggcattgcgtaatgaaactgtcctgacactcaatacatcctccgcaaaatcaatattgatccgcggtgccagaagaaattcaaacattacctatcccaaccgggaatggggatatggaatgctggatctctataactcattcttacgtatacggcagtaactgcgcgttttcctatcccctcatttcaatcatagggccgccgcttttttccagataggctcttgttatgacaacagagcctatattggaatccttcggtatctcatacatgatgtcaagcatgaactcctctatgatcgccctgagcgcacgcgctcccgtttctttcttgatggcttcctccgcaatccactccaatgcttcgtcttcaaatacaagcttaacctcatccagttccaaaagcttcacatactgcttcaaaatcgcattcttgggttccctcagcaccttaaccatcagctcttttgtgagcgcctggagcgtaacaacaatcggaaggcggcccaggaattcaggaatcatgccgaatgtacggagatcctccgtagtcaccttggtcaaaatatccggatctgactcatatttgtcgcgcagctctcccataaagcccattgtagttgattttgtcagtctttctctaacaatatcctccaaatcaggaaatgcaccgccgcagataaacagaatatgattggtatctaccgtggtcatcggagtgagagcgttcttctggttggagcctacaggcacctccacctgactgccctccaagagctttaacagctcctgctgtacggattctccgctgacgtcacggttcgttatattcttctttttagctatcttatcaatttcatcgataaaaatgattccatgctccgctttctccacatcattgtcggccgctgacagcagttttgacacaacgctctcgatgtcgtcccctatgtagccggcctccgtaagggaagtggcgtctgcgatggccagaggcacgtccaaaagccgcgccagtgttttgacaagatatgttttgccgcttccggtcgggccaatcatcaggatattggacttttcaatctgtaccttctcctcctgattttcatcctgcccgccgttctgtaaaagaacacgcttatagtggttgtagactgcaacagagatgacttttttcgctttctcctgtccgattacatactcgtcaagacgggattttatcacgtgcggcgcagggatgtccctgatactgaattcctgctgtttcttttcttcctctttctctttcttcttttttaccttatttttcttcggaatctcaagattcatattctccagattcggaaaatcactgagattcatattcatataaggcatattctgaagcttgctgaaatccaggccgctctgtgtgactgaatcaaatgccttctgcatacaatcgtggcagaaattcatgcctcccggcattgtaatcattgtaccggccttgctctccggacgacggcagacataacaaattttttcataatcatcatctccgtctgatttcggtgcagcgccgtccggtttctgttcgccgccttctgatgtcacagttgtctcttcatcaattttattatctttatctctgtcttccaaagtctatttcctcctgtctgtaaacggattttgatttcctttattcaatttcccttatctctattatctcatgcgccgtgtccagctcgtcgcgtatcagcgccctgtctccgtactccgcttccccggtctgattatcatacggatcgctgccgggccgcttcatcggcggtgtaaactcccagccgaattccgagttcatcggaatccggaacggatccaggttgccgaaataaaattctcttctctcttttacatcgtccctgtatgcaccgcccccgaatgaacagtcggcatacagccatccataaggttcgatataaaactgcgcccagtcatgacagccgatatcgcgcggatttgcataaagtcctgcctgccatctggccggaacgcccgcgatccggcacatggttatgaaaagcagcgcctggatgccgcagtcccctttctgacctgccgccgcatattccggaatatccgttatcgtgaaataagaacggacaaaggaatacgtcacatgggaagttatgtactcataaatgcgttttaccctgcaaagcggattttcctcacttcccgccacttcttccgtcaggcttttgagaaacggtgtgaacctgatctggggaagctgttccccaagccagttcccaagcctgctgccgtcaggtaataccttccctgcatccgccgcgccagttaccctgttctcatctaattcaatataaggcgtatgattctcaaattcatattcaattgaaaatacactgttttccgtcagctcagtctcaaaacataccgtcctctgcggccacagaggcggcgctgtcctgagaggctccatcgatgtgtgaagaagcctgaaattcctgacctgtgcatattccagaggaatcggcagataaacacgtactgtttttcccggttcaaatgcctcttcccgaatcttcaacgtactcctgatacggaaataataggcaaggccgcctttttccttcattctctttatggtctgatcacgcagacggccttccagctctccctccgccagagccgatttatcgaaaatacgcgctctgatatctttcctggtctttacaagattgtcgacaaaatcatccttaatccttctctcaccctcaatatacagccagtctattgcattttcatcaatcaggttctcaagttcttcctctgaaaaaccttctatccgctccgttgcaaaggcaagggccgcctgatggctgaagggatactgaagcggaagccgcctgataatatcacgctccaatacaagcctttccttcattatcccggggatgtcttttccgaggcggttctctataatcttcagcgccctggtaaaatcaccgtgccacttcagtttttcaatatcttccggcagcgggacagtcagtgccgccaggtttttcgctctgttttcttccatcttatttactccttagatgacggcagtatctgccgttattcactttgttctgctttccagtatacaatacttatacagaaaagtcattggaaagttttgttgaggaagggaggaagctgctgttcacacggttgtgcctgcgagatgttttcgtgcgcattttgcaggaaaatcccgagttttacggcgcgccgctttttggcggggtgtgaacagtagcgtgaggccttcccggtataaaagacttatcagcaggatattttctcaccattaaaaatgtgatagaataatcacatgataccagggtcaaaaggttggaaatctgatgcaagcttgcttgcatgaagatttttaatcttgggacccgccaaaaacatgagtaagaagccatttttcgcagaaaaatgagcggattgcgaatgtttttgaggattgtgagagcacgcagtgcggagcaatccggtatcaaagggggcaaaagaccttttgaccccaacatcatcatattggaatcaggctggatctggctgaacgataatctgaatatctgaaaggaaagagcattatgtggtttctatttgcattaggttcatccgtatttgcggcgttgacttctatccttgctaaaattggtatcgatggggtgaattctactctggcaacggcaattcgtacaatcgttgtcctactcatgtcatggggaatggtttttctgaccaatacccagggcggaatgatagaaatcagccggaaaagctggatatttttgattttgtcgggtgttgcaaccggcgcctcatggctttgttattataaagcgctgcagatgggcgaggcttccagggttatccctgtcgataagctcagcattattatcacaatggtgatggctgccgtaattttgcatgaaccgtttacggttcgttccgctcttggctgtgtcctgattggggccggcactctgcttatggttctgtaaaaatttcggcaacgataatcttcacgctcgccacaggttaccgccttcaacgataaccagcacgctccgcgaacaggtgaccgtcatcaataaaaggcacagtaccggccggcagcggttaactccgtactgccggccatgacactgtgcctccgacgtttattcgccgcggtgcggcatttagttttcctgtacctcctgtttctggctgtcttttttataaccgagtgtgataggtatctgtctctccacataggagccgttttccaggctctgcaccgtcagtgtgaccgacgtgcctcccttataatatgtcagcatcttttgaagttcatcacctgtcctgactgtttctccatcgaatttagtaatgatatcacgttcgcgtaaatcggaatttgtggagagatttcctgaactttccttattttacaggcttttcagcccattagatagtgaaatgatatgtattttcccttatttttgcccttatgcggaatccgtaagggaaataagggaaatttttgtttaagcgttgctcgctactttatcaagaagtcttgcggaatcccgttttgcttttcttgttgagtgagcgtaaatattcattgtggtactgacatcagaatgtcctaacagttcctgtacatctttcggagccgccccgttggagagcaggttgctggtataggtgtgacgtaactggtggaagtgaaaatcttcaaatccttccagcttctttgacactgacctgcaagcaatgccgagtgtactcggcagttccagactaccatccggtctgaggcagacaaaggatatttctttataatctgccgggacttcctgcgttccgtcaaggtgatagtattcataatacaccctgttttttacatgcacctctttgtagtagttgcggtggtaaagttccccgtactgcatccggcttttcagttgttcccgtcttgctgctttcaatatttcagtcagtgtatctccaaaatcaacaatccttactttctttcgcttggttgttccaatcacatttttatgcttcgttccgtcataacggatactgcgttttatggtcaggcattgttcttcaaggttgatgtcctgccatgtaagaccacaggtttccccgatacgaagtcctgcataatatgcgatctgaatcggcagaattgcaggtggatttttcttttccagatacttgataagccgctcgtaatcctcatgtgaaatcggctgtgtaccttcttctacctcatcatcagaaaagaggtcaacttcctctgcctgtcgtttcagcttgatatattgcattggattgaaactgattaactgttttggaaatactgcaaaacggaaagactgctgtaacactgcggaaaaagaatggatataatctttgctatatccttttcgcacttttccatccggaaactcgccaccgaatgtaagcaggtcgagaaaactctgtaaatgttcagcggtaactgtttttaactttcggtctgcaatcgggtgttttttgatacatcggattgcaccaagataattttccactgtgccattgctgagtgttccggctttcagttcttcttccgcccacatatccagaagttctcctaccgtaaggctttctgcccttgcgacaaacttcttattttcataatcttccagtgctttgcggagaagcttttccgtctcacttttactttcggttccggcgtattctttctgaaccatttttccgcttgcgtcctctacatagaagcgatagtaccatttctttcctttttttctaacagatccttttgccataatcgtatgtctcctttcgatatcagacaatcggaactgctgaaatgcttcttgcgtgtaagtatatcacaactccggttgtcttactataccgattcagaatcctcatacataacttcggataaaagatttgcaagcctttgttctgccgcttccggtttctttgaatagagccttacaacatctgccatatcgttaaatgcgttgacagtatgcgtgatctccctgagaaacataatctcattatattcatctttcgattcaaatcccattactttagcaatgtccgcatctttggtactgcctttgtaatttttacaggcgaactgaaacgaatccagaaacagttcatattgctttaacattaacagcagtaagtctttagaaaaagcgtcttctgttttattaagatcaagaggtaactgtttgagaatatcgcccatcacatcacgaatctgcaattctttcttatccgtaatatcagtttcatattcatcggtttcccctttgagccattcaatcgatacatgaagtgcttccgaaagaccttccagtaccatctttttggtattgtcaatcgaaccattctcataacgcaggattgtggaagcggtaactcccatcttctctgcgacataaggctgtgtcagatttaattcgagacggcgctgttttgccctgctgccgatcagcttgcgtagttctttatctttcatgctgatgtgcctcctttttcggtatgtcattactataccacgcaacaaaatacattgcaatatgcaattaatggaaaaagaataaaatttcataatgcttgacaaagcaatataaacacgctatactgacagcacaaatgaaattgcataatgcaatttaaaaggaggtggtcatatgacacaaagaaagattgccttatctattgaagaagctgctgattatacgggaatcggcaggaacaccctgagaaaactggtggaatggaagaaacttccggtattaaaggtcgggagaaaagtcctgatcaaaacggatatgctggaactttttatggaagccaacgagggcagagacttgagggataagggaaatgtgaaagcagtcacaagaaacggttcaacttaaaaaagcggttcccgaagaaaccgccaaaggttctatcagaccggagtcatgatatacctacacgcaaacagattataccatgtacttcgtctgacagacaacaggaaacttatgtttggaagaaaaagaaaggacgatgatatttatggcaagatcaacaaagagttatgaggagcgtatgctccagttggaaaagaaagaacaggaaagccttgagaaagcaaaacagtatgcagcacagaaacgggaactgaagaaacgtcagaaagatgtggaaaccaaaaagcggacacacaggctctgccagattggtggtgcggtggaatcggtgctgggttctgcgattgaggaagatgatatcccaaagctgatcggcttcttaaaaaggcaggaagcaaatgggagattcttctcaaaggcaatgcagaaagagccagttgcgaatacggaggaagtgtaatgccggagggagtggatttttcattcccttcattgctttttcatgaagggcgcacttatggacaaccagaggtcgtccgtataagtttgccacaggtggcaaccggtctgcgcttacgcttgccgggctcgttccgtcggcgggcatttcatgcagacctgctcatgccgcaggaggcactcttcgccagaggggcgcattccatgcaggctgttattcacagggcactcttacgcagagggcgttccggcagataccattttctttttgggaaaacgttacctgccggaaatcaaagccggatacggcagaaagggggaaacggatcatggcgatttttcattatacagtaaagattgttggacgcagcaaagggaaatccatcatatcagcatctgcctatctcaatggtgatgtgatgaaaaatgaagaaaccggcagaatcagctactacacttccaaaagagaagttgtttataccagcctattgatgtgtgaaaatgcaccacaggaatggctgaatgtacctgctgaaaatatcagacggttccagaaatctgtccgatataaaagggcagataacaaagaagccgcactgaaaaaatttaaacttacttttcagaagcagcgtttatggaatgaagttttgaggatagaaaaaagtgcagatgcacaactcggcaggtcatttgagttctcacttccgaaagaatggaacagacaggaacagattgattatacaaccgaatatattcaaaagacctttgtaaataagggaatgtgtgcggactggagtatccacgataaaggagatggaaatccccatgtgcatttacttgtgacgatgcgaccattcaatccagaccactcatgggggaacaaagaaatcaaggattgggagtttgtcagagatgaaaatggaaatattgtggtggatgaatcccatccggactggtggcaggataaaaaggaccctgaccgtcatggaatccgaatcccggtattggacgaaaacggtaatcagaaagtcggtgcaaggaaccgtaaacagtggaaacgtgtattaaccgatgctaccggatggaacagtccgaaaaattgtgaactgtggcggagtgaatgggcgaatgtctgtaattcacatttgaaaacggaaaatcacattgaccaccgttcttatgcaaggcaggggaaattagagataccgacgatccatgagggcgcggatgccagaaaaattgatgagaaatttcaaaatgggcagacacaatcagcgtcatggaaagtggtagaaaatcagatcataaaaagacaaaatgcactgctggataaaatacagatttctttcggaaaggtatccggtgcattgacacaatggaaggagcgattggatgacattagaagaaagccgggaagtcattcccatgatggagacaatgataaaccagatcgaggaacagcagaattttatggcagcgatggtacaggaattgcaggaacgggatcgacagctcctgtcttttcaggagcagaaccagagtttaaaaagcttaaacagcgaattatccaggctgctaaatcttttgccagatacagaagaactgctctcacagatcgagcaacagaaaaccagaatcgaacagttggaaaacgagaatcagcaatggcaggaattaacgcagaagctgaacaacgagaacagcttattgcagaaacagaacagcgaattgctgaccttaaacagcagatagagaaagcgagggagatcgatgagcgaatgcagaaacttagagaacgtcgggcaggtggaagaacttctgctgatgaccgaacagatgcaggacgaactggatcagaaagaccagacaatccaggaactaaacaggcagctaagcgaatcgctgaccttgaacgagaaattgaacagcgaaaacagagccgagaatatcgaagcattgcggacaagattaaggcaaacagaggaacgattgaccagcgagacagacagcaggaaaagagccgacgcagaagccgtggcatggaaatttaagtatgaaaaagcagagcaggaaaaactttatgcacagacacaccaaaagacggtagaggtagctgttgagaaaaaagtgccttatgagaaatgtgaaaaatgtgaccgtactgcttaccggaaagcaaaagaaaaatgcgatagccgtaaaagccagttagaaaagaaatataaaaatatgacgattggttatgaaagtatcttgtttctactggcatggtacagcataacaacaacactgtttactgcgattctttcgccggttttccttaacgactgtatcgtctttttcggtgcgttaggaaaaggaatgggaagtttatttcgggagtttgtgacaggtgcagactctttcggacagttaagcagtggaatacctaacagtattctttccgggattgtgtactggctgattgccggtactgtcatggcaattttattcgtaataaccgggtggctgataatcgggattggttatcaggtaggaaaaatctaccggaaatattgttgggatatcatcagtatcgtggtagcgataacgagtacagctgttgtaatttactttggagaatggattaaaaacgctaatccgataaatcttattgtattgctattactgtcgcatattatttatattggaatcagatgttatgtgaaagactggatggaagaacgaggatattattaaaagaggacagggaaatttcataatcttcctgtccttagtaagggactattgattgtttatataaagaaaaagtatataaataaatcttgacaattagtacgaactcggactataatacaaaagtccggattcgtactaatttaaggaggaaaaagatgagaaaagataataatatgataatacagttgcaacgatattatgctttatgggaagaatgtacagcaatgtatgaggaatggtcaaaggatcagggactgtcttcaaatggagtttttgctttgtattcattttatgaaagtaatggaagatgcacgcagaaaatgataagtgaaaaatggaatatacctaagcaaacggtaaatacgatactaaaagattttcagaaaaaaggatacatcaatatggtatctgatgattcagacaagagaaataagctgatatgcctcacagaatcaggaatggaatatacgaaagatatcatagaaaaactgcactcaaaagaaatatatgtaatcgaaaaaatgggattagagaatatagaaagtcttaatgataatacagagctgtttatcagacttttcaaggaaggagattgtaagaaaaatgaatcataaatcattattttttaaatatgttattccatctattatagcatttgcattatcaggaatatatgcgatagtggatggatattttgtaggcaataccataggagatgctggactttcggctattaatattgcatatccgattgatgctttgattcaggctcttggaacaggaattggtatgggaggagctgtttattactcaattaatgcagcagaaaagaaaggaaaacgggcagaagaatttattgctacaagctggtggcttcttgtaatagtaagtgttatcagtaccataattatttactccttttcgtctaaaattttaggattgcttggagcagatggaattatattaacaaatgcgacagattatatcaaaattatagcacttggagcaatattgcagattcttggaactggaatgatgccattcattagaaattatggaaactctttctggtcaatgtttgcgatggttggtggattcataaccaatattgttctggattttatctttgtatggatatatgaaatgggcatgaaaggtgcagccacagctacaatagccggacagggtgtgactgcagcaattgcaatcatatacgcattatataataaaaagttttatgtgtatgtatccttaaaaaatgtaaaagaaatgtgtggcgctatattcagagtaggtcttgcaccatttgggctagcattgactcctaatatttcattggtgtttataaaccgattctccgcttcttatgggggagaaaaagctattgcaacttatgcatgtgtatcctatattatctgtatcatatatctcatattgcagggcgtaggtgatggaagtcaacctttaatgagccgtttttatggtgagaaggatcaagaaagcctgagaggagttcagagaatggcatacatttttgcaataattcttgctgtttgtggtggaattatcatgtatgtaaacagagcaaatattggaggggttttcggagcttcttatgaagtaagtattgagatttctaaaattgtacctatatttttagtgtcattaccatttgttgcgattaccagaatagcgacagctggattttatgctactgaaaaaagtggattgtcatacattcttacattcattgaaccagtattgatgctgatatttatgcttgttttaccacctttatttggtggacagattatgatatggtggagtatggtattggcacgtgttttttcagcgattctggcattcatactaataaaatattgcgaaaagggagatttgcaatatggaatacagaaaatttaacaatcagatagtagcaagaataatctaggtttatctattgtatttttaaggacagcctcatagcaatagggctgtccttttaaaattatgaagctaatttttaataaattctagtagattttgattggaataatcataactctaatgaatcttcagcatctacccacatctgtaaattcccatcaagatataaccttgcatattctaatggctcatcgattgcaagcgatgtcaaagcacaatcagatccaggtgtggttcttaaatttttttctgcttcccaacaatcaatacggagtatatagcccgtattagtatatacatcaatgctgttgcactgtggattgtattctgcaaatattgttctcatcgtatcccatctccttatcatttaatcaatcagtagtagcaaaaattaagaagcatttcaatcagttcaccatgtcacttttattttgtgttatactgtcttatagatttttcttgcccttgtatttgcccttatcagagtgcataaacactgatgggacgatataacacaagggaaataataagggaaagctcacctgcgacaaatccagtgttttcaaggggttgcgaagaatttaataataaaatataacagttattaaatttcttaaaacaggtgaaatctcaatcggaatttgccgctgctccgccctctacaatcttataaacatagattccttccggcatgccgtaagccttcgccattctgctgtcgatattctgcagctggattccgaggtaaccctgttcctcttcatccacggcaatcttcgtggtcttcgtcatcaggtcgtcaatgatatctttggcaaaggaaatcggaatcgcatatccgataccctccacatccgtatcggcgtatttggccgcattgatgccgatcacctcgccctgcatgttcagaagcgctccgccgctgttacctgggttaatagccgcatcaacctggagaagagtcctgtcaacaccgtcgattgtaacctccttatttaacgcgcttacataacctaccgtaacggactggccctgaccaagcgcattaccgattgcaaccacgccctgaccaagcttcaacgtgtctgaatcgccgagtactgccggctgaatctttccttttgtctcatccggaatatccgaaagctttacagcaattaccgccaggtccgaatctgaatccgtgcccttgaccgctgcctttaccgttgtattgtcgataaatgtgactgacagctcctccgaatctgcaaccacatggttgttggtcacgataagcagttctgaatcattctgccctgctataataccggagccgctgctcggcacttcataggactgtttcccgaaaaaccagtcttcctgtgtataaaccattttattattgattgcaactacggaaggcattgctttgtcaacaattgccgaaacgtcattcccggttgaaacgggtactgccgctgccgtagtcggctgctccataaccgcctgtgaagaaagcgcaggcgcttcactgctctggaccgtctccggaaccagtttgtccgccagaatattaacaccggccatcgttcctccggctacacagccaaaaataattcccgccgccgcgattcccgctgcccttttagccatgtaaccgccctttttcccgtttcgccccggctcctgcggaatatagcttctgtccggtttcctgtcctgatatgttccctcactccgctccctgccttcggcattgccggtatacctggaatcatgatagccgctgtatctgctgtccgtctgccgtgaggatgtgctgtccgaataagatccttccgtatagtccaggtcgctgtccgtattctggtcctgcctggagccgccgccctgatatttattgtagtcattctcattatacatagttattgctcctttctttttctctattttttcattcataatttatatcatttatatctttacatggcatagtctatcagtaatttgtgatggaactgtgaagaaagtatcaccaaactatgtttttttaaattttcagtaccagttcagtcagagcgctattgatgagagatttaactgaggttgggaggacgcgtccggaacggaccatgtccggtgcggtgagggggatggctgagtcttccgtccccgtgggaagttggttgtggagggggaatccggccggaatgaattgctgcggggaccgtttgcactctttggagtgcgcagcagtgctaagctcgtgagggacctcgccaagcaccggcggactcccatgtcccctccgcaattgattccgcctacttccccggttcaggttatcgcagggacggaagactcaggcggaagttttcgcggcaccggacatggtccgctccggccgctgattgtctctaaccttaaatggggaggaccctgtcgcgaccactacgtgtttccggcaggccgatatcaaatcttccacaattccttaataaaggtgcattgaaagcatatcgtatttcccgttcacggaagctcttagtggccgcgacaaggtccgccctgcacttaacgcgtgagacattcagcggccgcaggccaacggacggggccgatacacttggcggagtctttcgttccggcgaaaaccttccgggagaaggagatactgccgacatcttccggcggagaaggagagaatgatatccggaaggacgttcgcccgagagatgatagctcttaggcagagggagacaaagtgcgccgggcggattttagccctacaagggcaaaatccgggacaacttgagcttcgaactcattcggagttcggagcgaatttgtccgtaaccccggggggctttgccttcctctgtcttagagctatccctcgaagaagcagtccagccggatatcattctctccggctccgccctgcgaaaacaaaaccacagtatctccttctccatccagcgatgccaaacccccgggacgaaagactcatatacacaccccaccaccccgtccgctggccgtaccggcggcgtcctcacctgcttaactaaatctctattttctgcttgccacccggatcctgctcctgtatacttgagttgcagtccggtcggccttatacggccgcatgatatgagaataaagaaccgtaaagcagaaaaagaaagaaggatattcaatatgaaagaaacggcaattgtacatataaagaaaggggaggcccgttccctgaaagcgggaggtatgtggatttatgacaatgaaatcgctcggattgaaggggagtttgagaacggtgatatggtaaaagtactggactttgacggttatgtcctgggaagcggtttcattaatacaaggtctaaactgacagtacgtatgatgtcccgtaaaaaagatgcggtgattgatgaaaattttattgagatgcgtgtcagaaatgcctgggaatacaggaaagccaccgtggatacttcgagctgcagacttatcttcggcgaagcagattttcttcccggtattgtgattgataaattttccgatattctggttgtggaatcactggcttttggtatcgaccgatggaaaccggtcattctggaaaaattgaaaaaggttctgctggaggacgccatatccatccgcggagtctatgaacgcagtgacgccaaggtccgcctgcaggagggaatggaacggtataagggatttattggagagccctttgatacccgcgtggaaatcgtcgagaatggagtacgctaccttgtggatgtaaaagacggccagaagacgggatttttcctggaccagaaatataacaggctggccatccagaagctctgcaaagggaaacgcgttctcgactgctttacccacaccggctcttttgccttaaacgccgctgtttccggcgcgtccgaggtgcttggcgtagatgcctcggaactcggaatcactcaggcaagacagaatgctgagttaaacggcgtatcaggcaccacctcattcctctgtgccgatgtatttgaacttcttccctcattggaacataacggggaaaaattcgacgttgtcattctggatccgcccgcatttacaaaatccagaaattctgtgaagaatgcggtaaagggatatcgggaaatcaacatgagagggctgaaacttgttaaggacggcggctttcttgccacctgttcctgctctcactttatgactccggagctttttaccaggaccatccgtgaagcagccggcagcgttcacaaacgcctccgtcaggtagagtacagaacacaggctgccgatcatccgattctctggtccggtgacgaatcgtcctattacctgaaattctacatattccaggtatgcgaagagaaataaaaaacagcgccggtgcggcgggattctgtcagagaacccgatctgcaccggtgctgcttttttgttattgaagacaatgacctgtgcgcgtagcatgcaggtcatcgttctgccgtgcgttttaatagcccatagggccggagaactctacatttccggttccgggagcattgctgtttccgctgttccctccggttccggtacccggaggaagaattacgcccgtatccgtgttgctgcccggtgcctggttctgggaggcggaaccgcccggagtattattgctgctccccccaggcgcattattgttactgcctcccggccggctgctgttatttcctcctggtgtaccgctgttatttcctcccgatgtgctgctgttattaccacccggtgtgccgctgttatttcctcccggggaattaccgccgcccggcatattattattgttccccggcgcatttgtgccgcctggaacattactgttgttatttccgccgtttctcccggaaccggtgcccggattatatccgtttgtaccctcggttcccggacggctgctctccgtcgtacccggtcttacaatactgcctcccgtctcttcctccgacggcctgccggatccgctctcgctctctctggtcgggaatatcatatttccctgggaatccgtctcctgctgcacagattcacccggatattccgcagactgggattcacctgttcccaaactgccatgctcattttccatcgattccccggagtgaccggtgccgttctcctttgtttctttcgtttcctccgcctctgtagtctttggaaccgaacctccgcccgtaccaacatccccggccggtttcgcttccttcgcaaggcctgtgtcggaaataatctttctgctgatcgactttaccgtatccgtcggtatataattttcatctccaaacaggaacctgtgaagctctatcacattcttctcaagtgtctgtgggataacgcagtctcccttctttcccatcttcgcctcgcctctcgcgcttggaaaaccggtcgaatcactcagatggaatttcggaagcgttcttccgattgatatcaaatcacttagctccacgctggtggatacctgagggtatatcgtctgtatcacattattgatcgttgcccagtcggccttcttgaacttctcaaacgccagtgagataaccttcctttggcgttccgtacgggcataatccgtatccatcagacgaagtcttccgtatgccactgcctggacgccgtctaaatggttcattcccgttttctttaaatggacggagtagactcccgttgccttgaccgtctccgtgataaatgcattgatataataaagctctgctttgcttatttccacatcaataccgcccagaatgttgatggcatcggctaccgccttccagttgaaggtggcgtaatcgtcaatatccagatccaggttcttattcagcgccttcactgcctgctccggcccgccctgcagataggcggcattaattttattataagagttcttatcgctgatattcaggtatgtgtcacggtaaacagaaaccagcttaatctcaccggtgtccatgttaatattgcataccatgttgacatcggagttgttccctttacccactgatgaattccggctgtccacaccaaaaacggcgattgtccaatagcccttcatctgctcctgtttctcctcggaaatttctatgtttttaatctcatccggattccagtcgagccttgacataccgctcaaccgcttgtccacgtaagaatatgctgcaaaaatgataacgcttaaaagaatcagtacttcaaaaagaataattacaatctttctttttcttctttttgccttttttctggcaggggtactgtaaattccactgtccttctccggctctcctctgcgtctgcttttctgcttctcctgctgcggttcttttcttccgcgcttctgcctcctgctctctttctccggtccaggcctgtcataattctgtctgcggccgccatcctctctgaatgtgtctgtgatcaggttaagcccgggctgtgaatgccctggctcccggtatcttctctgttcaatttctctgtctcccatccgtttgacaggctgtctggcccggctccttctgtttcgggagcgctctgcctcatcatcatatcccatgcagttgacctcatcttgtataattaccgtttcgcgccgttatatagtaacgccggcagtcactacccggcctggctagacggctaagctgtaaatattaatacgcattcttattgataaatcctttaaagaatgtcagaaataaaattttaaaatcaaaacccagcgtccagttttcgatgtaataaagatcgtgttctattcttctggtaatcgaggtatctcccctgtatccgtttacctgggcccagcccgtcattcccggcctaacctgatgtttgatcatataacgcggaatttcctctttgaacttctcgacgaaaaaggggcgttccggtctgggacctaccaggctcatatcccccttcagcacattaaacagctgcggcatctcgtctatactcgttttccggataaaacggccaatcgaggtaactctgggatctcccggcgttgtccactggctcttttccttcgtcggaggctgaactgccatcgagcggaatttatacatcttaaatggcttgttgtgaagcccgacccgctcctggctgaatataaccggccccggcgaagtcaccttgataccgattacggtaagcagcataaacggggaaaacagtacaagggccacaaccgcgccgaatatgtccacgccccgtttcatcgttgcgttcatgaggctggtcagcgggacatgccggatatggattacagggagtccctgaagatcctccataaacggctttgtcggtataaaattatggtaatcgggaataaactttgtatggacgcccgatttctcacagacagccacaatccgttccaaatcgccatactcgttaatactcagcgtaatggctatttcgtcaagggtattgagcgccagaatttcatccaggtccgttgttttcccgatgacacggatattcttatattcttttccccactcttcatggtcgtcaagaattcccctgaccttatatccccattccggattggcattgacacgatcgataaaaccttccgccgcccggctgtaaccaaccaaaagaagatgtttctggttgtaccctttggaacgcatggaacggagcgccctgcgcagaatgctcctgaccgaaaattcggcaattacattgattacaaagaaaagcaccagcatctggccggaaaagttaccgaaataatcattctttctgcacgcaaacagaaccagagcaatactcagtaaaccaattgtattggcctttaaaatattcgccagttccagtctgcgcccctgaacacgctttggcgtatacaggtggaaaaaagcatagaggatcaggtaaagcggcacaataatgacagctgcaatcaggtaaactgccgccatagcctgcttattatgagccgtgacgcctgaccatggatttccaatctgaatataccaggccagagcaaaggaaagtaatattacaattgcatccagcaccacatgaaaattattcagacgtttctgattatcttttatcatagtatctcacccagctcctgctgttattcatcaaggcggtgaaaaggtttcattccgaacttttcaccgccgtttttcttaagctcccgggcctgaagggccgcctgcgcctgccgggttcgcaccctgcgtctggctgggagccgtattatttcccaatggggaatttccgccagaaggagaatttgttcctgatggagagttatttcctgacggagagttattccctgacggagaattattccctggcggggaaacgtttcctgatgccgacgtactctccgatgtcggtttgctgctgttgtttggcttggtctcgcccggtttggccacgttagaattgcctggtccggtcgcagctggtcccgtcgcattattttcgtcggcttccgttgtcctgtcggaattgcttcccggcctgctcggtctcgtggaggatcctggtccgcttcccgggccggtacttcccgggccgtaattttcttcatcgtcccagtcaccccagtcgtcccagccgtcccagtcatcccagccgtctcctgtaccggattcgctgctgtctgccgtctggctttcatccgtcgaggactcctctgtctcatccgtcgaggactcttccgtctcctcttccgtctgcttcgccgtcgccgccactttatccgcctgtttcttaacctgcctgttaatatagttgcgggcattaataccctgatcgacaggaacatgactaatcagttttccttctttatacatgccggatacactggctatatgctcactgtactgcttaacattagatggcacctgataatcctgcgcatcgaaaaggaatttatggagttctttcacgttgtattcaagcgtctgcggcaccacacagtctcctattttgccaatatcaagctctcctctggcagccgggaaaccgtatgtatcacccatatggtaattcttgatattccttgcaagcggaatcaaatccggcaggtcaaggtttgtcgccacctgtggaactactgtctcaagaatacagttcagcgtaacccagtcggccgattttgctttttcaaatgccttgttcagaacaatacgctggcgttccgtacgggcatagtccgtatctcccagtctcagacgtccgtaagcaaccgcctgtacaccgtctaaatgtacatcaccggcttttttcagatgcgtggagtaaattcccgtctcctcaaccgtctcggtaatatacgcattaatccaggaaaattcgttttcgctgatggtaatatcgatgcctcccaaaaggttgatggcatccgccaccgccttccagttaaatgtcgcatactgggtgatattgagtcccagattcttattcagcgccttaacggcctgctccggtccgccctgcgcataagcatagttaatcttattataagagtttttatcatttacattcagataagtgtctctgaatacggaaacgagacggatttcccctgtttccaggttgacgctgcaaatcatgttaacgtctgagttcgtacccttgccgacattcatcttcccgccgacgtttctggaatccacaccgaaacaggcaattgtcatatagcccttcattccttctatctgggcatcggtaagctccgggtttttaacctcttcttcgttaaactcaattttctgaaatgagccaaaggttctctcatatacataccagccggcggcgcccacaacaatcaccagaagaatcaggatctccgcggcgatgatcataatccgctttttcttgtccggccttcttctcctgttatttactttctgctccctgcgcccttttccggcagttcctcttgcagaacctcccctgcttgaacttcctctggtgcttccctttggtccgctgtacccggaacggaaagcgtcaccgcccccatctgcgctccggcgcgtatccgtgccgcgcccggagccgctctgcgacgcattccgtctctgctctctgcgggccctcatgcgctccagctcatcgtcctcgtaattcataagacacctcaactttcgcttgtttttttctttcgtcttctgacggcaaactcatacatatagataaaagtgccggcaatcagctccatctcaattgtgagataatgcattaagttttccggcctgtacttcacctttttacaggtgtgcgccgtcttcagaccttctttcaggccttccagatagtctttttcataccccagttttctgaaaaacagatactttaaaactgtgcctgccgcgatcggaaccgcattaataaaaagctgcaataacggcatatttttatagttcaggtaaacattattccgtgcagccagtttaactttaaaagaattatatttggatccgctggttccgctgcccacatgatacacgacagccgccggacagtatacattgtcatatccctctatcctggcccggtacccaacatcaatatcctccagataagcaaagtgcatctcgtcgaaatatccaatttgctcaaatatatccctcctgtagatagcggcgcccgcacaggaagaaaacaccctgcacgcttttttgtagcgcctgatatcctggcccacgccgcgctggaaggcccagccgagaagtgaatacatatccccggcatcatccatcagctccggatgatacatctgtatcattttgctgctgacggagaaaatcttttcagagcgttcaatggctctcaccatctccgcaacaaaatattcgtccaccctggtatcattgttcagcaaaagcacataaggtgtttccgatgcccggatgccaatgttgaccgctcctgaaaatcctgtatttttatccagaaaaatcgtatcaatctgatgctccctaagccactccgcacttccgtcggaggagccgttatctactgccagaatcctgaagttcttataggtctgggcattcagcgcccggatacattcgtccataaacttcattccgttgtaattgggaataataacagttgtagttaattccattctcgtttcctttaaaaccactgttcacagccggcaaaccgcgttccgtgaacagcagctctttaaatatccagtttgtatggttcccctatcttttccttttttaaatccctcagggcaaaattcgactttctgagagtcaggtttggattgtaatacggatcgccgttctttaaaatctccggccatttttccgaaaaaatcttaatctccctgttaaaacgctccaccttttccggagtgtcctccagtcccctggacttggattcataatgatacagaagggcatatggattatatacaactaattttccggctttttgcaccttcatgcaataatcgatatcattaaaagcgacggccagttcttccgaaaaaccgcccacctcttcaaaaagggcctttttactcatcatacaggcagccgtcacggcactgtagtcctgagtgctcatcgcacggtggaaatagctgttctccgcgcggtgcaggccgataaacgtgtgccctgcgattccgccgaatcccacgacaactcctgcgtgctggatcgtatcatcctgataaagaagttttgcaccggcaatccccacatcatcgcgctggcataagcccagcagttcctcgatgaagttcggcgcaatcagctccgtgtcgttatttaaaaacagcagatattttccctttgcaaaggtcacaccgtaattattgatagcggcataattaaactcccgctcccagttcacaacgcgtacattggaaaattccttctgtatcctgtcataataatcaaaggtttctttcttcgtgctgttattttccaccacgatgaattccaggttcttataggttgcgcgttcctctatgccccggatacaggtgtccagatccatatggtgatccttatttggaataataacggaaacaaggggattgtccttaatccggtataccgaatggtatattccgtaatcgacccccttttccactttttccgcctcaatccctactctgtcataatgggccataatcgccctggctcctgcctcaaacgcatacagcttgctttcgggattgctggccgtggaatcctgatggcagcgccaatgatataaaaccttggggatatggcagatttttgctgcccgttccgtacagcggaagataaagtcataatcctgcgctccgtcaaattcatggcaaaatccgccgacctctgccgcaagctcatggctcaccacaaacagatggcagatataattgacgctgcggagcagatcaatattaaagtctggtttgaaatggggatcgaagagcgcccccccgtccatgtccagcttatcttcatctgaatagagaacatcgcattccggattttcattaatcttctttgcacattcatataaagcatccggtgtcatcatatcgtcatggtccgccaggacgataaaatccccgtccgccatatcgattgcggcattcgtattaccggaaatccccttattctctcccagaatcacatatttaaagcgcctgtctttttccgcatagcgccggagtacacgctccacgctctcgcctctcggacttccgtccgcaacgcagacctcccattttgcgtaggtctgtgccagaattgaatcaagcatctctttcagatagcgttccggcgtcttgtaaaccggtatgacaatggaaaatttcggcatgtagtcaaaccgctcctgcctctgccgctccagttcctcatttgaaggccttgtcagggaataccactcgccatagtcgtaatcattgtcaatcccctgaagcttgtgttttgatttgagcagaagggcctttaacccattctctttccagaaatcaagacagacgtgaaccgtctccatattcatcagatcccggatcttctgtatccgtttatgggccacgctgcttcttttctttattaaatcctcattatatttaacccggatccgcctgttttcaccacggattaccagataatagtcttttccccggacgtaagggaactgaatatcaaatccaaattcccgatccatcactctgccaaaataaatctggctcacatcgtcccttctggtcgggacatacttgtgttccagagaatggcgggcctcgtcctccacatcaaacgcaatcttcgcatccggcgtctttccaatggcccagccgttgagctgtattgaattctcacgtatcctcactacatctacattaaatttcatccctgcacctgctgttcccggccggcttccacgtccgcattacacggggttttgcctctgtcctgtggattactctccggatgatgattctcctcaaagttcagcctctcttcctcaatcacaagcggccgcttcatcactcttgaattaatagacagaatatactctcctacaagaccgatgaaaaaaatttgtacagaccccaggaagcacatgccgatgagaaccggggccattcctgccggaaaatcataccagtataataatttcataataagataaacaaatgctaccaccatgctgacggctgcacagatactgccgaaaattgtcgccaggcgcagtcccactttcgtgtaagaggtaatgctcagcatggcggcatcgtataatttataaaagttgttgtgcgtcttcccggctcttctctccggctggatataaggaatctcttttcgcttatatcccagttccgccacaatgccacgtaagaacggggtcggatcgtccaatccgcggagtatctcgataaagtccctgtcatagagtccggagccggtaaaatgttctatctgctcaacatcggacagcctctttatcattttataataacagcttctaagccagtacatgaccggattctctttgctgccttttttaattccgattacaattttatagccgttctcccattctctgacatactgtggaatcagttccaccggatcctgaaaatccgctaccatactgatcacgcagtctccggttacctggagcattccataatagggggaattaaactggccgaaattctttgcattgaagatagccttgatgcggcggttttcactgcagagcctgcgaagaatcggccgcgtattatcagatgaatcattatcaataaataccagctcataatcatagcccggcagatcccgttctatggtttttacaatctcttcgctgatagggccgacattttcttcttcgttgtaacagggtattaaaatgctgattttcttcatttgaaaatatctctcttttctattttcctgttttataggaaacgtcatacatcttttccttatggcgtatcctgtgccgattttttccgcgtaaacgcagaagcttccttgcaaaaatcgtgcacctcccccggagggttattaaacggcaattttttgtcgtttaatataaaactttttcctgttttgaacgctccctttattctaaacgcctttgctgtatttgacaacctacaattttcttaaaatattaaggattccctgctcaaaatggatttccggagtccatcctgtcacccttttcatctttccgatatcaggaataagatttaccaccccttccgcattcggctgcctcaggccgtattcgaagctccccctgttctcgcaaagcctgtaaatttcttctacaaatccccggagggagcgggtctcttccatcggtcccgccagattgtagacacagccatgctccagcaaactgccttcatattccgccaggccggccagcgcccgcccggcatcttcaatataaagaaaattccacatctgcgtacagtctgaaagctccatatggccgccatgcaaaaaggtatcaatacaagtggaaatcagggaccagggatgatctcccggcccatatgtgctgaaaatgcaggcatgtccatagtccagagagagttccctgcacagcttttcagcctcccgccggacctttaattttgcttccccataaggagaggcaggacggcaggttatggtttcatccatcagcgtattatgaacgccgtattccgcctgggagccggtaaagagaaagcggcggcagccgagagcctttgccgtcctcaccgcattcagggcgtcctgcacgcttctctcctggatccctgcgtcttttctggaactgtttccggctccgcgccatcccatatggagaaacacatcacagtgttcttccatcctgttaaccaggttacccaaatttcctaaatcttcttccaaaagtgtaagattttccggtatttttccattttgcaagagtttgtccgcctttgcggagttctctctgagaacagcaaaaacgcagtgtcctctgtccagcagctcttttaccgcccctgttccgacaaagctggtcgctcccgttactactatattcatgcctcttccttttgttttatgattttatggtttgttttatagctcgtttctatggttcgcttttatgtgtttgttcaattaattcttgatcctcgggatgaacataatttgttccatctcctcatccggcaggaaaggagccaaatcctccagaggcggcgataccagagtgccgtccggcagcttcttggccgcagatttcggttcaaaattctgttcaagtgtcacaaatacctcacagataaccgggccgtccattgccagcgtctcctccaccttttctccaacctcgccattgttatggattgcgacgtatggaaaaccataggcccatgccagcttctccatgctcggaaatgtcaaatcaccgctgtctacaccgattcccactaaaggctcaccaaagaaattcttctgtgtctggcggatagagtgataaccaccattgttaataacaaaaatcttaattggcaggtaattgccaatcactgtctgcaattcctgaagattcatctgaatgctgccatcgcccgtaacgagaactatatcctggctgtgatccgccacacaggccccgatagcggcaggcagtccatatcccatagacgcaattcccgagtttgagataaaacgctgtccctttttcatgatattgccatggccgcagactacattggcagagccattgccaaccacgacaatctgcccttcattcagacgctcgctcatcagcctggcaaaggcatatacattggcttccgtctctgttccgtcttccagatggcgttccaggacaaccggatagtcgcgtttccacccctggcaggtctgcacccactcagcctgggccttctgaaacgcctcgtcagccggggcagcgccctccggcgttccttccgcatccaatatttcttccatcaccgtgagaagctcttttacatcggcgtggaccggcatatccacgtgcagtgtcggtttctttaattcttcggcgtctatatcgttgacaattacataagccgccctggcccatgtgtcgaaacggtaaccaatctggcggaagctcagacggctgcccagagataagagcaggtcgctgttctgaattgcaaagttgccggccctgtccccgacatttccgcctttgcctacatacagaggatgttcatcataaatgcagtctatactgtccgctcccgttgccaccggaattcccagtttttccaccacacgcataaacacctcatgggcccctccgatacggattccattgcctgcattgatgacaggacgcctggaagtacggattttttcaataatagccctggccgtatcatgtgtcaccggttccggaagaatttcccggtattctccatttccctttatatcctccgcaatctctgaagcagaaggagccgcccagcctgttccgcctgctttatatgattctgcgtcaaagccgattaaatcctccgtctccactacagctgcctgtacattcagaggaatatcgagccataccggacccggccggccgctgtatgccagatagagggctttctccatacagaagcggattctcatcggatcgatgaccatctcacaatattttgtcatattcgccactgatttggtaatatcatattcctgatcgcccatggccctcaaatggagtccggtgcttcttgccgtcgtatcataccggacctggcccgagatcacaaacatcggaatcgaatccatgtaaccgccggccacgcctgtcatagcgttaattcctcctggcccggtggtaacgcagacagcggcaatcttattattaattctggcataactctccgccgccatggcacaggcctgttcatggtgattatacatgcagtgaagtccctcctgatgccccagagcatcatccagatgcatcgcacctccgccggtgattaaaaatacatccgtgatcccactctctaaaagtttttccgcaatatagttggaaacttttttttgcataataatttcttctcctcttttaaatcttctctataaagttttatttttattcgtaaaatacctcattaagtcttcatattataccacactcgcttctgtctgcctatataagattttcttacatatcctgctgtacaaaacaaattggagatttaactgaggttgggaggacgcgtccggaacggaccaggtccggtgtggtgagggaggctgtctgagtcttccgtccccggttggaggttgtcgttaggggggaatccggccggaatgaattgctgcggggaccgtttgcactctttggagtgcgcatcggaatgctaagctcgtgagggacctcgctaagcaccggcggactcccatgtcccctccgcaattgattccgcctacttccccggggcagtttttcaccggggacggaacactcaggcggaggttttcgacaccggacatggtccgttccgggcgctgattgtctccaaccttaaatggggagggccctgtcgcggccactacgtgtttccgcaggcagataccaaatctagcgccttttataaaggcgcaatgaaggcatatcgtatttcccgtacacggtagcactgagtggcctcgacaaggtccgcccccgcacttaacgcgtgagactatcagcggccgcaggccagcggacggggccgatacacccggcggagtctttcgttccggcgaaaaccttccgggagaaggagatactgccgacatcttccggcggagaaggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtaaccccggggggctttgtcttcctctggcttagagctatccctcgaagaagcagtccagccggatatcattctctccggctccgccctgcgaaaacaaaaccacagtatctccttctccatccagcgatgccaaacccccgggacgaaagactcatatacacaccccaccaccccgtccgctggccgtaccggcggcgtcctcacctgcttaactaaatctccaaaacctattgtttttttctccgaacttttctataattgcatatatgcttgacgaaatttccgtcaaaaggaggcagcactatgaaaattgtcgggataatccccgcacggtttaattcgacccgttttcccggaaaagtcctatctcttctggataacaggccactaatctggcatgtatacaatgcggctgctgaaagcggcatattggacgcagtctgcgttgcagcagaccatgaggcagttcagaaagcatgcgccgaatataatattccctgtctgataaccggaacctggcatccgaatccgacttccaggatctgggaagctgccgggcaggtggaagctgatttttatgtcatgatgggggccgatgagccgatgatatcccccggcgatatccgccaggtggttcatcaggctgtcaaagccatgtcggagacctccggactgccggaatcggacaggcctttcgtcgtgaacgccatggcgtccattacttccgcacccgaagtattcgactcagccaatataaaaatcgtatgcagccaggcaggaaaatgtctgtatgcttcccgcagtcctgttccttatcccaaaggcagtcttgattacagctataaaaaattcgtaagtatcggggtctacaccaaagaagcgctcgacttttttgccgcttctcccatatcccgactggaaaagatagaggaattcgacctgctgcgtttcatagagcagggtaaaaacgttatatttgaagacatctccggttcaacgctgtccgttgacacaccaaaagatctggaacggatcagagagcagtttgaagaccggaaacgcaacgagaaataaaggagccgcaaatgatacctgaaccaacgaacaatcctgccggcagacaggaaaaatcccaccgccgctaccgcggcattatatttgatctggacggcactctgcttgacacagcaaaaggcgttttggaaagtgtgctgtataccactaaaactatgggatatgaacccccgcgtgaggacatgatgaagactttcatcggcccgccaatcaagcactcgcttataaaagtctatggtattgacgaggaagaggccaaccgggccaccgaaattttccgcaaccggtataaggattacgatcttttgaaagcaaccccctacgatggcctgatcgaacttcttagaagtcttaaaagagaggggtatctgatcggtgtcgccactctgaaaagagaggattatgccctcacacttttggagcactatcaaatcagcaattactgcgactgcatctgcggcagcgattttgccagcaagatgcagaaaaccgatgttttagataaatgcctgaagggcttaaacctgtcccctgcggaagcagttttgattggcgacactgcctccgacggcagcggcgcaaaatgctccggaactgattttattgcagtcacctacggcttcggcccctccgaccctgatggctggaaagagtttgagcctgtttttatcgccggtaaaccggctgacattggtatgtttctgggcctggcgccggaaatctgaaaggagtcattatgaaggaaataaaattacttgactgtacactgcgcgacggtggatttgtcaatgactgggagtttggctatggcaatatcatcaatatttttgaacgcctgatcagttccggcgtggatgtgctggaaatcggttttctggatgaccggcggccatttgacaaaaacagaaccattatgcctgatacaaaaagcgccgacgacattttcggcaggctggacaaaggcaatgccatgattgtggccatgatcgactacggaacctgccgtatcgaaaatcttgccccctgcgccgaatcctttatcgacggaatacgcgtcatatttaaaaaacacgtaatgaaagaagccattgcctactgccgcgaggtaaaacagctcggctatcaggtctatgtccaggcggtttcgatcaccagctactctgacagagaaattttggatttaatcgagcttgtaaatgaactgaatccctatgcgttatccattgtagacacttacggtttacttcatcaggaaaatctgatgcactactttgaactgtttaatcacaacctgaaccgggaaatcggtatcggctatcattcccataacaatttccagctggcgtattcaaacagtatagaagtactccgcgagacggccgaccgccgtgttctgattgatgcatccttgtacggcatgggaaaaagcgcgggcaacctcccgctggaactgatttccatgtatatgaatacgagctgcggcaggaatttcaataccgcacagatgctggaagccattgatatcaatattatgccgtttttcaggaaaagcccctggggttataatcttttcttctatatctccgcctcaaacaactgtcatccaagctatgttaaattcctgatggataagcagaccttgtctttgaaggcattgaacggaattctggacaacattgagccggagaaaaaactgctctatgacaaagattacattgaacagctttaccgtacttaccaaagcaccgagtgcaatgatgagacggaactggcagaattaacaaaagccctggcaggtaaggctctcctgctcctgggacccggcaaaaatatggaacttcagaaagctcgcgtgctatcccatatagaaaagacaaatcctgtaatcatctccgtaaactatattccggatgatattgctatcgactatgctttcttaagtaattcccggcgctatgtccagctgggaagccgccttctggagctgaaagaccgtacagaccggaaagtaaaggttattgcgacttccaatgtcaccaatgttaaggatcgctttgactacacactgaattacagctccctgattgacccaaatgcggaaatcattgacaactccttcgtgatgctgttaaatgtccttgtcaaaaccagagtaagtcatgccgcatgcgccggttttgacggttacacttatcatggggacaactattttaacgccgatatggattaccggattgcccgcgaaaaatcacagggaatcaaccaatatgtcacagaaacgctggaccgtcttgcaggaactctcaatgttgagttcatcaccgattcaagatatcataaataattttaccgttttggcggaaatacagccccaacccctgcaccgtgcagaggacagggctgtattttttatctcttttcctctccggggcttttcatccgcttcttcgcagggaaacggcagcgccgcgccttcgaattatcaccgctcctatttccttccatccttaccagcaacctgcactatctttttcggcgccggataggatataatcacaacgtaatgcaacgatggattttcggccagaaacattgaacgaaaaaggagagattaaaaatgcgcaagcaaacaaaatttatggctgtattatccgctgcggcaatcatgactgcggctgcaccaatgatgacaaactattcaggaatctacacttcttacgcagcatccaaggggtgggtggaagaagacggcagctggtacttctatgatgaagacggctacaaagaaacaaacacctggaagaaaaaagacagtgaatggttttacctggatgaaaacggcgatcttgccgtaagtcagagaatcgatgagtattacgtgaattccacaggccgcatggtaaaaaaccagtgggtatccgtggacaacgacgaagaatacgacagccctgattctccgggcggcgctaactggaattactttggcaaggacggcaaaatcgttacttccaaatggatgacaataggcggaaaaacctactacttcgacgaagacggccagatgctgacaggactcgttgaaatcgacggatttacctactatcttggaaacgaaagcgacggagccagaaaaacaggctgggtacttttagaagaaatgacaaacgatacggacgatgagggcatctggtgctattttgacgaaaacggaaaaatgattatggatcagatggatcgtaaaataaacggcaattactatacatttatcgatggcaaaatgcagacaggctgggttaatgtagccgaggcaggattcatctcttctgcggctgctgccaccgaaagcgaggcggattcctccctttccttaaaagacttccgctactatgatgaagagaatgacggaaaaagagcatccggctggttcacaattgaaggggctccgggaatcaatgagagcgataacgaatttaccttctactttaaaaacggagaagcgttccacgcagaaaagaatctggaactcttcaccatcaattctaacaaatactgttttaacaacaagggcgagatgcagacaggtattcaggttctgactgatgatgccggcaaagaagcaacttattacttcaatgagaacggcattatgcagacaggaaaacagactatttatgatgaggatcttgaagaaaaccagacatggtacttccatgcaaagggttctctgaaaggacagggataccatggggaacgtgacaaccaggtttatttaaacggcctgcttcagaaagctgacccggaactccgttacgaggcggttaccgtaggcgaaaaacgttacctgattaacacaagcggcaacatccagaaagcatcctccacctccacatcctctgcaaaaccggagttaggaaaaggttttaaagacattaaagatacaaatgatactgtctggacagttgacagttcaggaatcatccagtaatatattaatatcatccgttcataaataccgtaggccgtcttgacggaaccgcggtattttttcttgtcaaatttaactttgtactattaatggcatttccaggttctttttcagttttgtggatcatataataaagtgaacaaattcggtgaattgttcattatgtttttttaaaagtacattttaagctgtaacatttgtcttttttatacgttttctatagtaagtatggtattttatgaccaaatgttgtaatgtagatatggagtggatattaccgtatttatatcgggttacaaactatcacagatgacgggagataaaattatgcgtgaattgactgtttactattgttccaaatgcggccgttatggcttctatcaggtttcgaagaatgccatttgccccgtatgtaagacacctatgactgtctttcctatgtcctaccagaactttatggatatggattataatatgcgcgaccagctcatttctgatcagatagcaggcaacgtaaccccacagacttcggttgtacagcggcttaccgaacagagcaaaacatccaacagccgctctgccatagcaaagctgaaggccaggaacgaagaactggaatatgaaaacctggaccttcaccagaagaatgcagaacttgagaaaacaattgattggatgcatgatatgatttgggatttaacacgcaagctccacgggaatgccaatgaataacattcgtgcatttgcttcaggattttaatcacctaacagagtacatataaacagaattaagtcggttcaaaaacagggcaggaatcattatctcttaactgataatatgattacctgccctgttttttatctgcttttctcatttacgatgtaacggctaacaagaagattcatactttctttcaactgaaccaccgtattgaacaaggtatcgacttcttctttcagttcgaaattctccttctccagtaaagcaatccgcttagcctcctccataaccctcttcctccttcatgctatgtaaatcaacacttatatttataatataaatctgttgaaaaataaaggccttatccaccgcaaatttcgacaatacaacacaataatattgtatattttcacattatcagcaccggactgtactgcagtgtcattcactataaaacaatacagccgattacttttttgccgagactcctgacaagatccagctcctgctcgattccgccaaacagggaaccgccccgctgttccacaagaatgaccgcatcacaagctgcagctttcttaatagccgaagcatcttttccaagatttccgcctaccgaaagcgctgcggcgcccagcatagaggcgagtccggcgcgtacctgctccagcttctcagtctccaccgttccgacgaggattacatccgctgccctatcctgctccatatagttcagggcatttgcagccaccacttcgaatgttctgctgtcttccatctctctgcctgatacgccttccatcttatccagccatttgtcaacaaagccgaaggcacgtttcttatcgttccggcggaaaacaccaagaaccataatgccgtatctgcgtttcagttctttctcattcacaagcttatcactcataaggaatgcaacacagaggaagaatacagctataaacgcgccaagaacaccgccaaggactgcgtacttgactgcactctttaaaacgcttcccttactcaaaagattgttcttcggctccgccagctcggacaattccttcgttttttgcttcaggctgatatccagctgatccatattggcggaaaactctgtctgtgttttatcaagctctaaatcaacggtgacaaactgtgactcgtccaccaggttattctcatgctcccctatcgcttccgtaatactgtctttggaggatgctatgctgtccttaatataccccattacatcgctggccgtctttctcgtgtcaccgattaccgtaatatcaagcatattattatcataatcaggcacgatcttcaccagctctttcagatagcggattcctatcttattattcatcttgcccagtacgtaattgtacatctctccgttctgtgcaatagacatataagccttcagaatgctggcagccgtattcgggttctgatacatcatccccggcataatagcataatctgtcgatatgtaaaaagtggccgtctccacatattcgtcatatggattgatattcataagaatcgaatgatctttatattcctgctggctttcaatattctgctgcaggttttcaatctctttttccaggcgccccttcgtagagttatactgatccaggttcatcacataggtatcctggttcttcttaacgtactcctcatctcccagctgtctgattccctttactgtctttaatgcacccagtaaaacggcgaatacaacggcaattactataatcggacgccatttgcgcaaaacggcaaacatcaaatccttcaaatcaatttcctgttcataattattgttcggttccatcggacaaaactcctcctattgtacatgctttatttatcttagcataaacggttgaaatgcgcaattgggattggctgtaaaaaactttaagatttccttatgccttagattccccgctgtaaaaatcaaacggcagtcatctgatccatgtatactttcttctggctcatattgctgtgaacgtagatatccattgtgattttgacggaagaatggcccagtatctcagaaagtgacttgctgtcaaaaccgttttctatccactgtgaggcgaaggaatggcgcagggcatgtatatttacgtccggcagcctgagcttccttaaaaggttcttaaagcgcctctggacgcctctgggctccatacagccggtcctgccggtcagaaggtaacagcctgcttcccgtttcttttccttcagccgcggaatcataaaatcgggaagaggaatttccctctgggatgttccggttttaggtgagcctatatatagaacggttttggctgccgtgttcttttgatccgtattccggatacgtgaaacggtgcgcctgatatgcaggactccctcctccaggtccacgtcttcccatttcacgccgcacagttctcccactctgattccagtgctgagcgacaaaagcagccccagttcaaaatttgttctgcatccggccagccagctaagcagctttcttctgttgtcctggctcaaaagcttcatttcatatcctctgtccttgggaagaaagaaatccagaggttctgccggacagattcctcttctttcccccgcgcgtatgatactctttaaaagaaaaagtatcaggcgcattgtgttagccgacaggcccctgctttgacggtccagaataaattcgcttagaatctcgttattcatttcctccatctccacagttccgatagacggtctgatgtgtttctggatgatcgttgcataacaggcaaacgtacttggtttgacctgatacctcatggagagcttccacgcttcgcacaggtgtgagatagtgtgatttcctggtgggtcgatgtgtttcatttcctcttgtgtcataatcctcttctcctttgcaagttcttatccatttacggatacgactatcatagcaaaggcttgctctaagtacaaaaataaggagccatgaccggctccttattctgaactctgaaatttatgataagctgacggcaacgcagcagacggcaaaacaggcagtgccgatactatggtttccagccggatggagtactagagcgtgtctgaaaattgctttccgtcagatgtgcgtctcactttgtgggagatttggcccgaatgagcgcggcgtagtgggctacggtaagcgaatttgggccaaatatgccgcgaagtggggcgtgcagatggcgggtatgaattttcagacacgctctagccttccttccggatatacgtgggtacaatcttctgcactgctgctttgatatctatttcatcaccgttggcttcttcataaagctcatccagctgtttcttaaacagttcttcatcaaagtcaatcggccttcctatatgaatctgtttattaggcgtatcgagaaggccttcctcgtccatcagaagctcctcatagagcttctccccaggcctcaggcctgtaaactcaatcatgatatcttcatttggtacataaccggacaaacgtatcaggtttttggccaaatccagtattttgacaggttctcccatatccaggacaaatatttccccgccctttgcataggagccagcctggagtaccagagacacagcctccggaatcgtcataaagtaacggattatatccgggtgtgtaaccgttacaggcccgccttccgctatctgttttttaaacaggggaattacggagccgttgcttcccagaacattgccaaacctgactgcgacaaaatctgtttttgactccttattaagcatctgtatgaccatctcacacatacgcttggacgctcccataatattggtcggattcaccgccttatcggtggaaatcagcacaaaacgctccacaccgtatctgctggctgctttcgctgtcttatatgtaccaaatacattattctttacggcctcgttcgggctgtcctccatcagcgggacatgcttgtgagccgccgcatggtagacaatctgcggcctgtattgctcaaaaatactgttcattctgtgcgtattgcggaccgaaccgatcagcaccactaaatccagctccggataagtccttctcagctcctgctggatatcatatgcattattctcgtatatgtctacaataataagctgttttgggttatggctcgcaatctggcggcaaagctcgcttccgatggaaccgcctccgcctgtgacgagaatcaccttgttgctgacatatcccattatctcgtccagattgacgcgaatcgggtcacggcccagaagatcctctatctgcacttcccgaagctttgacacactgacgtcaccgttgaggagctggaaaattcccggaagaattttcaactggcaatttgtttcacggcagatttccagaatctttttgatttcctttgccggagcggacggtgccgccacatatattttatcaaccttgtacttttcaactagctgcggaatatcatatctgtttcccgcaatcggaactccgttgagaaatttgccaatcttattcttatcgtcatccacaaagcaggcgactcttccatgggcaaactggctggtctctatctccttcaggataatcgatccggaagttccggcccccacgatcagaatcctgctttcgctcacctcgccgtaccgcttaaacagggagcggtaaatacggtaggacagccttacaagcccctcacagcctgtcagtataataaaactgatggcaaaataacttctgggtacattaagctggagcattgtcatgcccgctatctggcagaggcttgtcaacacacaggcgaacacaatgtggcacgcttccctgactccggctacgctccacatcgaggaatacatgcggaatacatagaaaatcacaagcgtaataagcgtatacggtattgcatatttgaccgccgccattctgtaattttccggtatggactgaagccgcatatcaaatcgcatccacagtcccatgaaactgctgaactggattacgcatatgtcgaccagaagcagaaccaccattctgaattttttatctcgaggcatcatcttttcaaacattttatcattcctgcaacttttctaattattcttgttctcttttggatatcgaattttgaagcttttccggcacatctctgcacatcgccaggccgactgctaaaagcgcccacataaccggtgttgctatcggcaggttgatgttgacaaacgcctgcgctccatagcataccgttgcgccaagcggagccaggatccatggctgcttcttcacaaacctcatcattcttgcacagcttgatatgaggaagagaatatatgcaatcgtagcaaacggtcccattgtcacaagatactggaagtattcattatgtgcgctttcaaagtacacaccatagatatccagtgactcctgacggaacggccaggtaagaatgccaaaggtatcggggccaaatccaaataatttatgaatcagcggcaatctcatataagactcccatccaatccgccagcaataaccgcggttggtaccccagttgtcattaaatatcaaatattgggatacggacgaatacttttcaggattaggcccgaaattggcatcatacagcactgcaattacagccgcagcaccggctgcaatcaggcaaagccagctgatgcggagccatttccctattttatcttcttttcccttcatcataacacggtcgcctatatataatacagcaaccagcagccataatgcaataacaataacttccagatatttatgttccgccagcatattaaagatgccgctgagtccgattaccttctcggccatcttcttattgatctcatcaatcaccttgattaccgacataaacgatgctatcactaccgcataacgtatcaccccttttctcgttgcaaaaagtacaagggggaataatgcaaatactgctcccaatgcgagataggcattatcactctgtcccgtgataatagcgaaaaaactgatcagcaatacaagataataccaaatattccggaacacattcttctccgtgacaaagaagccgcatgaaactcccattaccagagccacgtaagccgtatacgtattaatattgccaagtgtggatgtaaatgaatctaactgcgtggacttgactccttctttccagctaaggacatccatcctgaaatagtcggtgataccgaacaggcacgcgaggactcctgccagaagaaaaagatccaaatgccattttttgattttcccaaacttgccaatcataaagacgcttaacgcatacaggcagataagaaacagtccgctgaaacgcccttcatttccccaaaatgattcaaatttgtaatcagacagtattgtcgaaagtgacgccaaaatgataaacaggattaggaatttataagctgccggctgctttttaagattctccggccggaaatggctgaaaaaccgcttggtattgacgccttcatactccatcctgtccacaaacagaaatacgatggcaacaatcaggcagattaccgccatcacaacaactgatatccagtaaaatttgtatttcgcctttaaaatgtcgaaataataattatgataatacagcggaaatacagctaaaacaacaaatgtaaataccgccataattcctgcataaacactaccggccacctccgccagcgtattcgggtccttcttcggtgcagctttcgccatgtgtcaaatctccttatatcttcatagaagcccatatctacaggctttttacagtatagcatctgttgatgggtaaatcaaccttcagggacttattcggcctgattcaaggtttaattttttattaaggctgctttgtttttcttcataaaataataaacaccccgggcaaaattcagtaaattttgccggaaaaagacagattccggcaagttactattcacagtccctctgaaaaatacggttctgagaacagtaacacgcttcgcaaaatagcggctgtgtatagtaactccagaaacatccggtgtcagggatctgtctattcaataaacaatagtaacagttcatgctgtctgaactgctacaaacaatatattaatggctatgatttttattatctgcatgttcatctaaaaatgactgcatttcagcgatttcttcattctgagtctcaacaatgttttttgcaaattcaataacctcttcattattggtatactttaaaattgactccgccatatctactgccatctgatgatgcaccatcattccttccgcaaatgccgtatccacgtcactcgtaaccatattatgtgacatgtcatggtctttcatcatagaatgatattctttcagatatgactgctcgtcctcataatccagctctttatcagtttcgatggcttttgccatttccttcatttcttctatttcctcttcctgtgttttaattatttcttctgccatctctttaaatgcaggatcctttttttcttttgcatattttaaatagcttttagacatttcaacagccgattcatgatggggaatcataccgtacagaaaatcaagagtagcgtttcctgtgtcctgtactttgtccatctcttcttgcattttattcatgatatcgttttgctctgtaacatagttatcggctgtatcttttttactgcatgcggtgaaggcaatggcggaaatgatgactgcagataaaagtaatatacgttttttcatggggggcctccaatatcgttatatttttcgtaacagttcagccatgctgtattccgcgaggtattttcggcgttttttcgtttctgtgatcatttgctgcagtttggccgaaagttgaactgtaactatttttcctattatgattcccattttttcctgaattatgtcattagagctttgtaatttccggcccatttactcttcaccataaaaatgacctcgtaatgcaattaggaatttcgaaaaatatttcaaaaagaaaaaaaggagagtgcattaattatgaaaaagcagactaaattagttgcagtattatctgcagcagctttactcgctatgggtgcttccatgacatctttcgccgctggttgggaaaaagatgattctggtatttggcactattatgatagtgatgacgagatggtaaccggtgagtggaagaaagacggtggaaagtggttctaccttaatgatgacggcgaaatgcagacagattcctgggttgacgatgagtactatgttggtgatgacggcgctatgctgatcaatacctggaagaagaccattacagatgatgatatggacgatccagaggaagatggcgagagctggtattactttggaagtaaaggtaagaaaactacttccggttctaaaaaagttaatggcaagacatactactttgacgaggacggcaaaatgcagtctggctggtatgcagatgacaaaaatgtttactatttaggcgatgaagatgacggagctagaaaatctggctggttatggttagaggcaccagatgcagatgacgatgatgaaaaagatgcagctgacgcagtaggacataacggtgaagacagcaacgatccttgtgatgaagaaggatggtactatttcggttctgacggtaagatgtacaaagatgctaagcagaagaaagtaaacggtaaatattactacttcaatgcacacggtcagatgctgtatgagtggatcaatggagtaaagacaaccatgggttccaatgctcagcttgatacagatgatgaaacagctcagaagaatgcatctcctagtgaagtgcgttatatgaaccaggtagaagaaggctggagagctgacggttggtatcagatcgacggtgctgacatccttggtgctggagacgatacagactggtactacttcaaggacggtaaagctaagagagctgagaagaaagatgatggtactagcttaatggatggtacttcaccagtttacagagcaaaaattaaaatcaatggtaaatacttctgctttaatgaaatcggtcagatgcagacaggtttacagccaatcggcagcaagagcggtatggtttcaggattatactactttgatgagaatggctacatgaagactggtaaagtttctaatgtagaagaagagaatgattccttcacatactacttcgaaacaaagaacagcaagaatggccagggtatcacaggcgagaagtctggttatctgtactggaatggtaagagacttgaagctgatgacgattacaagatttaccagaccgataaagatacttactatcttgtaaataacaagggtaaacttcagaaatctacaagcaagacatacgaagtagaaaaccttgatggcaaagaaatgaagttcgaatttaagagtaactacacaattaagtctgctaaagacgaagagggtaatgcagttaatctgagcgatttatcagctgaattacctaagatcgagctgttcgatagtgtaatcactcttacgaaagttgcaagtggtgattttgcacttgacgttaagcttgcggactaataagtttggttagaatgagtatataaaatgaatataggagcgtcgcataatgacatgaaatcatttagattttgtatcaggagcgatgctccttttttaggttctttgtcaatagttgggtgggattttaaggttctatactgaatgttggggtgtgctgaaaagcacacttccaacattcttttcgttgtaataaaatacatctataagaagcctcctaaacgcattatcccgaccaaagtttaatgttatggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgctccttcgcaaacgccgttacctctgcccatactgccgcaaacggttcacggaaccctattcgttcctccccagctaccaccgcaggacccgcaggctggcattttacattgtctccctgctccggcagaccttttccttaaaacagatcgcagagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccaaagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcgattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggatctgcgtctggcacaccgcatgaaagagtggttctatgatatctgccagatggaagcgtatcgtcagcagcagagggaatttgatgactggattgcgaatgcgcagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagccttttttttacagcccctattcaaaaaggcaagaaccggaaacccggccttgcctttttattatactgtttctcaaaaatctaatttataatcagaatctaagtttcagtaaatgaatcttactcagcttcatcaattccagcagctgaaattacgttgtcgtaaagttcgatcttcggtacatcaacgaagtctaacagctcgctgtcaagatctttgattgtgttaccgctaaacttgaactgtacgtcttccttatctgcaagctctaagtcatacttcttgctctcggatttctgaatcttaccctgtttatttacaagatagtacttgccatctacgaggtagattctataatcatcctctgcctcaagtctcttacccttccagtagaggtatccagatttctcgccggttacacccttgccgttgccgccattcttagtctggaaataatatgtgaaggaatcattctcttcctctacattagaaactttaccagtcttcatataaccgttgctatcaaaatagtaggtatctccattgatgtactgtaaaccagtctgcatctgacccttttcattgaatgcaaagtatttaccttcaaccttaatctttgctacataaactggagcaccatcatcagttaagccactattgtcagcaggttttgttttatctgctttcttagctttaccatctttgaagtagtaccagtcggtatcattgtttgcaccaaggtcttcagcaccatcgatctgataccagccgtctgctctccagccttcctctactacgttcatgtaatatacatcgctcggagttgcatttggattttcaccgtctaactgagcgttggaaccttttgtaactttagcgccattgatccactcatacagcatctggccgtgctcgttgaagtagtaatatttaccgttgatcttcttctgttttgcatctttatacatcttgccgttggaaccgaaccaataccagccttcttcgtcacatacatcacaatcatcatcacaaaggtcaatatcagcatcgtcgtccggtttttcaagccataaccatccagaggttctagcgccgtcgtcttcatcacctaagtaataaatatcgttgccatcctgataccagccatctctcatcttgccgtcgtcatcaaagaagtaagtctttccattgatcttctttgtatcagaagtggttttcttacccttggaaccgaaataataccatgagtcgccgtcatcttccggatcatccatatcttcgtcagcgagagtcttcttccaggtattaatcagcatagcgccgtcatcaccaacataatactcgtcgtcaacccagctgtctgtcaacatctcgccgtcatcatccaggtagaaccactttccaccgtctttcttccactctccagctaccatctcatcatcgctgtcataatagtgccagattccagcgtcatctttttcccaaccagcggcgaaagatgtcatggaagcacccatagcgagtaaagctgctgcagataaaactgcaactaatttagtctgctttctcataattaatgcactctcctttttttctttttgaaatatttttcgaaattcctaattgcattacgaggtcattatacttcggatatggaaaattatcaatagtttttttacaaattttccaactttttgttacaaagtgaaatttttgcacttcatactactgcttcattttctgggaagttgaccctgtctccgatacattcacattataatataactaatcccaaattaccataacttttctctgtgcatttccttacggaattgttacaaaaagtcgttattaaccaattattgtttttatattaatacaatcctaagaattgaggtttacaattaagaatttcatgctataatgttcatatctcatgattcaagtcgcttttttgaacactgcaaaaaatgtcgaaatcatgaatatacacaatatcctgtttaatttcaacaatttaatatactaattataaaagtggaggtttatgcatggatcgatacggattaatatgcaggagtatttatgaagattcagatgttacccaaagagagctgtcttcaattcttgggatatctcttggaagtgtaaataagctagtaggtgaatgcctgaaagacggtttgattcagaatcattctgaatatggtaaatacagtttaacggaaaaaggaatggaatatctggagcagtaccgtgttgatggcgctgttatcacggcggccggattcggttcacgttttgtcccgctctccttcgagacacccaaaggacttcttgaagtttttggcgaaaggatgattgagaggcaaatccgtcagcttcatgaggccggtattaccaacatcacgctgattgtgggttatttgaaggaaaaatttgaatatctcatcgataaatataatgtaaagctattttataacccggagtacacctgtaaaagcacgcttgctaccgtatatcagggcagagagcttttttacggtaaaaatatgtatcttctggtctcagacaactggattcgcaacaatatgttccatacttatgaatgcggctcctggtattcttccgtttatatggaaggcgatacatccgaatggtgtgttacggccaacaaaaaaggcaaaatttcatccatcaccatcggcggacatgattcctggacattatatggcccggctttcctgtcaaaggattttaccgaaaccttctttcctttactggaatccgattatcaccgtccgggaacggagcaatgctattgggaacacgttctgctgaactatatagacaaacttgatttttatgtaaactgccagcccgagcatcaggtctacgagtttgaaaatctggaagaattacgactgttcgatccaaaataccggaatcattcagacaacgaagcgatgcgcctggtttcacaggtcttccacgtaaaggaatccgcaatccgcaatatccgctgtctcaaggccggcatgactaataaatccttcctgttcgaggttaataatgaacattatatctgccgtattcccggccccggcacagagctgcttataaaccgtaaggaagaggaagcctcataccacgccgtcgagcctttagatatcacagagcatatcatttacttcgatggtgataacggatataaaattgccaaatattatgaaggttccagaaatgccgatgcaaaaaactgggatgacatcgcatcctgcatggcccttctgcgcaagctgcatcagtcggaattaacggtggaacatcattttaacctgcgtgaacggatcaatttttatgaaaagctctgtcagcatcatgaactccttctgtttgaggattacacggaagtaaggggatggatgaatcatctgctggatcgggtagaacgtctaaacaggccatgctgcctgtcacatatagactccgtggcggataactttctctttcttcccgacggaaccgtgcggctgatagactgggaatattcggctatgcatgatccgctgattgatatttccatgtgcagcatttattcatattacgatgcagaagagctggatcggctgctggaagtctatctggaacgaattcccactcctgaagaaagaattgcaacttatgcttacgcggcgctaggagggtttttgtggtgtctgtgggccgtattcaaaagtacggaaggagaagaattcggagaatatacaattatcatgtatcactacgcaaagcactattacaagagaatagcccggcttttcccggattaagcctccccgaatcaattgtaataaattatttataacttcactgtataaatatggtataatgaccgcatagcgggcattataccgcgcataaacggtttctgcgttcaccgcagaaatccggcgctgttttccgtcggagactccatattccctaaggaatatggtataatgaccgcatagcgggcattataccgcgcataaacggtttctgcgttcaccgcagaaatccggcgctgttttccgtcggagactccatgttccctgaggaacatggtataatgaccgcatagcgggcattataccgcgcaagttttagaagtttaaataatcatattaagtatttactacggatacagtgagcaaacactgtatgttttacacaggaggaggagtattatgatacacaagaaacgtatccaggctctggggcttgcctgtctggtcggcctgatgagcctgggccccgccgccgagagtctggccgccgtttcctggactaaaaataacggcgtctatataggcagcgacggcacatccattgccggagttgtcgccagaggtatcgacgtttcacactggaagcaggctattgactggaaagccgtcgcaggcgacgatatccagtttgttatgcttggaaccaggtatgacaatgccgtagatccttattttaagacaaatgcggatgcagccgctgcagctggccttaaggtgggagcttatatatattcttatgccactacaactgacatggcggttcaggaagcagattttattcttgatttaatcaaagattatcctatttcatatccggtagtatttgatgttgaggcgtccgttatgagcactttgacccctgctcagttaagtgacattattaatgctttctgcaaaaaaataaaagaagcaggctattatcctatgctctacgccaatgattactggctgacaaataaaatagatatgagcaaggttccctatgatgtatgggtcgcgcgatatgagactaagcatacctataacaaagcttccatgtggcaggctactaatcagggaactgtagccgggattaccggtaacgtagacatcaattttgcctataaggatttctcagccgtgatacctgccaaacaatggaggcagattaacaacaactggtattactattccgactacaaaaagcaaacaggctggattaacgacggcaacggctggtattacatgaaggatgacggcacacagcataaaggctggctccatatcgatgacaaatattactacttgaacgacaataccggcaagatgatcaccggatggcgcaaagatccttccacatccaaatggtattattttaattcagagggcgtaatggctaccggatggatacagggcaataacaaatggtactatctgaataacgacggaacgatggttaccgaatggctgaaagtcggggacagcacttactactacctaaagagcgacggttccatggctaccggatggtatcagatggataacagctggtattacttcaatccgaccggtgaactgatacgcggctggaccgacattgaaggttcccgttatcttcttggagatgatggcaagatgtataccggatggcagcagattgacggaaactggtactatttcggcagcaacggaaaaatgaggaccggttggcaggaaattgataaaacctggtattatctggatcagaacggaagaatgctgtccggatggcagcagattgacggtgaatactattatcttcacgacggcaagatgctgaccggatggctcagtgacagcaatggcagcaagtattacatgagtaccaattccggacgaatgacaagaggatggagaaaaatagacggttcctggttctattttaaccagaacggacatatgcagacaggatggctgaacctttccggcaagttctattacctcgatcccgaaagcgggaagatgacggaaaatgtttcccgtgtcattgataatgtaaattatacttttgacaataatggtgtctgccagaatgaaacaaataatatgagcggaatcgccgacagttactttgatccgaattctttgaagaattcatcctccggttcccaaaacggccagacgaataacacttcccaatcaccatcaggcaacagcagctcaccatctggcaacaacagcttcccatccggcaacggcagctcaccatccggcaacggcagctcaccatcgggtaacggcagctcgccatcgggcaacagcagttcgccgtccggcaacagcagctcttccggcggccctacaggtggccatgtaactaacgccggcgcttcaaccggcggtgggaatgcccccggaagttcgaatggcagcgtaactgctccgggaacttcgggcaataataataatagcaataataacaatccgagcacaaatccgggcggttcttctgctccgggcagcattaaccattcttcaggcagcggcagttcgtttgccccaggcagttcctccggctccggcagcagcagcggaggattacagccaggcctcaccaccggtcccggacggtaatccactggttcaatgaactaaaccgcccccaataagtcaggcttaaaaatccaacttattgggggcggttcatttatagttacttttcacatccttgccaaaagacggctatgctgtaaaaaataacacgcgggacattaccgtgtgaaaagtaacgatttatatactgtaaaactaagtattaatccttacgcctacacttcaaaaatcaaatctccatagcttgggaacggccaaagctctttgtcaacaatcatttccagcttatcaaccggaattctaagagccttcatcgcagtagtcacattctccagacagtaatacgcccgctccttgctgtttgaaatgccggctgcaatcccggctttctcttcaagagcggcaagcgctacttttacttctgacagcagatccgaggtttcaagaatcagctctttctgtacgctgacatccgcctccggacatgcatctctgactgcggaaagcgattttgccaactgcgtcgtgtacgcaacaacggccggaacaatctgtttccctgccatatcgatcatcgtctttgcctcaatattgattgtcttggcataagattcatattcgatctcagctctggactccagctccgccttcgtataaacactgaatttttcaaaaagatgcaccgctttttccgtaatcagggcagaaacggaatcaatgccggatttcagattcggcaggcctctcctctcagcttcttccacccattcatccgaatagccgtttccactgaatataattcttctgtgctttgcgaaaagctctttaatcatatcatggacggccatatcgaaatcttctgctttttcaagctgatccgccgcctgcttgaacgcttcggccacaatcgtattcagcaccacattcggtgaggatacggaatccgaagagcccaccatacggaactcaaacttattccctgtaaaagcgaatggtgaagttctgttccgatctgtggcgtcctttgcaaaatcgggcagtgtcgtcacgcctgttttgagaactcctccctgaatcgaatgggctgcggaaccggtgctgcaaagctggtctattacgtcttccaactgctcacccaggaaaatggaaatgatagccggcggagcttctgctgctcccagacggtgatcattgccgggaaccgccgttgattctctcagcagatcggcgtgaatatccaccgctttcataatgcaggccagaaccagaaggaactggatattctcatgcggtgtttccccgggattcatcagattgattccatcatccgtggtcagcgaccagttattatgtttaccggaaccattgattcccgcaaacggtttttcatgaagcaggcaggtcaggccatgatgtccggcaatccgtttcagcgcctccatcaccatctggttgtggtcaaccgccacattgacctgtgtatagacaggagccagctcatgctgagccggagccgcttcattgtgctgcgtcttggcacagactcccagacgccacatttcttcattgacttctttcataaaagcgccgacacggggacggatacttccgaaataatggtcgtccatctcctggcctttcggaggcatggcgccaaacagagtcctgttcgcgtaaatcagatcttttctctgcaaatatttttctttatcaatcagaaaatattcctgttccggtcccacatagggaatcaccctcttggatgtggtatttccaaataggcggataattctcaaagactgctcattaattgcctgcattgagcgcaaaagaggtgtttttttgtccagagcttcgcctctgtaagaacaaaaagcggtcggtatgtaaagcgtcactccccaggtatcttctctcagaaaagccggtgaagtacagtcccaggtcgtatatcccctggcctcgaacgtggatctcaggcctccggacgggaaagaggaagcgtcgggttcgcccttaatcaattcttttccggaaaactccatgataacccggcctgccgcatcgggtacggagataaaggcgtcgtgtttctcagcggtaacgccggtcagcggctgaaaccagtgggaataatgggtagcccctctctcaattgcccagtccttcattgcatgggccactacgtctgcaatggacggatccagttccgctccgtcctcgatagtttgttttagcttcttataaacacttttcggaaggcgctctttcattgccgtatcattaaatacattttttccaaaaatttcagccacgttaattgcgtcactcattctattctcccttaccagacgataaaattgatctgtaaacttttcactgccatcaaaaacgataacctgcacgctccgcgcacaggtcaccgccttcatttataatccggttattattccaatcaggctttgccaacggaaccaaacagctccatctttgtcttgactgtctccttaattgcttccgtacccggagccagaagtttacgcgggtcaaatcccttgccttccagatccttgcctgcctcaatatatttacgtgttgcttctgcaaaggcaagctggcactctgtgttcacgttaatcttggcaacgccgagagaaatcgcttttttaatcatatcctccggaattccggtaccgccatgaagaactaacggcatatcgccggtcttctctttaacggctgccagtgtctcaaagctgaggccaggccagtttgccggatatttgccatggatattgccgataccggctgcaagcatgtctacgccaaggtccgcaattgctttgcactcgtcgggatctgcacattcccccattccgacaacaccgtcttcttctccgccgatggagccaacctctgcctccagggataatcccttttcagcacagacctttaccagctcttttgtcttctccacattctcctcgatcggatagtgggaaccgtcaaacatgatggaagaaaatccggcttcaatacatttatagcatccttcgtaagagccgtggtctaaatgggttgctaccggaactgtaattttcagttcttcaatcattgcattcaccatatctgcaacagttttaaatccggccatatacttgcccgcaccctcagaaacaccgagaataaccggtgaattcagttcctgagcggtcagcagaatagcctttgtccattccaggttgttgatgttaaactgtccaactgcgtacttgccatctcttgctttctgaagcatgtcctttgcattaactaacatattacgaacctccttgtcgcttttctcacttacattcttttattatataccatacttttcgatttgggaagactgttaaaaaattggcatattattttatcccttttatttcagaatgtcagctaccgtactctccattgtatccggagtgcactgtatattgtggcggatttcagcgttcctaatctcctcgatggcagcgggcacggcaactccggaagctttctccatctcgtcaatcagttcgaattcatcttttccttcttcgcttccgtatattgcttccattacgcttcttgaaaatttgtacgggctggctgtggatgcaatcaccgttttcgccgtatcatttgtttctttcacatattttctatatacgcaggatgcgacgccggtatgagtgtcaatcatatagccggtatcgtcaaaaaggcgtttgatttcagcggcgttctcctcctgtgttgcgtaaccgccggaaaaatccgccattctctccctcatatcgtcggtaaccgtatatttcccgtccctggtcagttcttccatcagttccctggtctttgcggcatcgcagccggtagaaagataaatcagcctctcaagattgctggaaatcagaatatccatggacggagaggaagtcaggataaattctctctttctgtcatagataccggtctggaagaaatcatataaaactttattatcatttgacgcacatatcagcctgccaaccggaagtcccatctgctttgcaaaataagcggccagaatattaccgaaattaccggtcggaactgtaatattgattttttcgccatcctcaatttcaccgttttcgagaagcttcacataggcatagacataatacacaatctgcggaacaaggcgtccgatattgatcgaattggcggaagaaagctggtaccccttagccgccagttctttttcgaactctttatcattaaaaatcttctttacaccgttctgggcatcgtcaaagtttccgtcaattcccacaacgcttgtattatcccccttctgtgtcagcatctgaagttcctgtacgcggctgactccgtccttcgggtaaaatacaataattttggtcccttccacatcggcaaaaccagccatagctgcttttcccgtatcaccagatgtggcggtaagaataacaatcgtgttatcaatcttattttttctggcagccgcagtcatgaatctcgggaggatggatagcgccatatccttaaacgcaatcgtattgccgtgaaacagctccaggtaatatgccccgtctgcttttacgagaggtgcaatctcctccgtgtcgaatttactgtcgtaagcgcgtgcgatacagtccttcagctcctcttccgtaaaatccgacaggaataatttcattacttcataagccacttcctgataactcatctttgccagctcactgaaagagcggtcaaatacaggaattgtatccggcatgaaaaggcctccatcttctgcaagccctttcagaattgcctgtgatgccgttacatttttttcaccgccgcgggtactgctgtaatagattgccatgattctccatcctctcttttatcaaatgattgattatccgtagtttttgtcctgattatcgatgattcctggttaaaaattttaccatactttatatattagtgcaagaaaaatagagatttagttaagcaggtgaggacgccgccggtacggccagcggacggagtggtgggattgttttatgagtctttcgtcccgagggaagattgttgtgagttgggactgcgggcgaagataaagtctgcggagcacgctcccgctctgtgaaatgcatcgcgctgctaagctcgtaagggacctcgctaaacccccatgcctctgatgcggcaccaccataaatgaaactgcgagggcggcaggtgattgaaattgctgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgcatgagtgcgcgcaacattctggaataccttctcaccggagaattcttcgacgaagcaaagtatgatgaaatgtataaacagaaaatcattgcccacaatctcaaagccagcaaggaacagcttatcgatgatttaaatggtgtcatgaccccattacaacgtcgaatgatgaaagagctgctgtcccatctggatgaactcaatgttcatatcaacaatctggaagatgagattgataactttatgaaaccggaagaaaaaaaaagcgacacaagcaatccaggatgtaactggtatcggaaaaaacagttcccaggccattatttcggtgattggtacagacatgagtcgttttccaacggccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacaaggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatggatttcaacggcatccgcagactttatcttcccctccgccccaaggccgggttttcgccgggacgaaagactccgcagggggtatcgcccgtccgccggcctgcggccgctgaatgtctcacgcgttaagtgcgggggggggctgaccttgtcgcggccactaagagcttccgtgagcgggaaatacgatatgccttcgatgggtctattataaaaattgtggaggatttgatatcagcctgccggaaacacgtagtggcgcgacagggccctccccatttaaggttggagacaatcagcggccggaacggaccctgtccggtgccgcgaaaacctccgcctgagtcttccgtcccaggcgataacctgccccggggaagtaggcggaatcaattgcggaggggacatgggagtccgccggtgcttggcgaggtccctcacgagcttagcactgctgcgcactccaaagagtgcaaacggtccccgcagcaattcattccggccggattccccctccacaaccaacttcccacggggacggaagactcagccagccccctcaccacaccggacatggtccgttccggacgcgtcctcaaacctcagttaaatctccatttagatcgaagaataaccgtactgcacagactattatctatcggaagtatgtagtggcagcgacaaggttcccgtcccccctgaggttggagacaatcagcgcccggaacggaccatgtccggtgtgcgaaaacctccgcctgagtcttccgtccctggcgaaaatctgccccggggaagtaggcggaatcaattgcggaggggacatgggagtccgccggtgcttggcgaggtccctcacgagcttagcactgctgcgcactccaaagagtgcaaacggtccccgcagcaattcattccggccggattccccctccacgaccaacttcccacggggacggaagactcagccagccccctcaccacaccggacatggtccgttccgggcgcgtcctccacacctcagttaaatctccactgaatcttgccttccgccaccccctgctgtataataattacgatttacagcttaaatcaggaaaggcaatggtagaaatcatcatgcaatataataatatcgtaaccggaacatttataaaaagacccaaccgttttattgcccatgtactgatagacggcagggaaacggtctgccatgtgaaaaacacgggacggctcagagaatttcttttacccggcgcctcccttttactggagtttcatccggacgctgccttacaggggcgaaaaacggcttactccgttatcggcgtttataaagataacgccggatttgaacacaaacggctcctgatcaatatggattcccaggcgccgaaccaggcggcggccgaatggctggccggcagcggtctcgcttccgcggtaacgaatattaaaagggaaatcacttatcacgattcacgatttgacctcgctttttcagaagacggccatcccgccttcatggaggtaaaaggcgtcacactggaacaggacggagccgccatgtttcctgacgcaccaaccgaacgcggcgttaagcatattatggaattaagggaagctgctctggagggataccgcgcatatatacttttcgtgatacagatgaaaggcatcctttccttctctcccaaccgaaacacccatccagaatttgccgacgccctgaagcttgcctcagagtcgggcgtacgtattctggcccgggactgtattgtgacggaacatacgatgaaaattgatatgccggtgaacgtgattttataatctgtccccggctttcctgttgccaggcaccccagcccgtctcaagacatatctaataataaacctatcattttgtgatgtgagactatgttatatcccctaagtaaaatgaatatcggacagaccgcagagatttgctggctgtcagacaataaatccattaccggaagactccttgacctgggttttgaacccggaacccgtgttacctgtatcttaaaaaaatgcggggatgaactctccgcattcctcattaagggcgctgttatcgctcttcgccgcgaggatgccgatctggtatttatcaaagaaaatgaaacggaaatggaggaatcctgtttatgagtcagcaaaagctctttaccatcggacttgccggaacccctaacgtgggtaaaagcactattttcaatgcactgacaaaaatgcatcagcacaccggaaactggtcgggaaaaaccgtggcctgctgcagcggccagttccattataaagatgtttcctgtctgatcgtcgatttgcccggtacctactctctcagaacacactcggaggaagaggaaatcgccagagaatatattgtatccggagaacccgacctgctgttagtcgtctgcgacgctacctgcccggaacgcggcctgcgcctgttaaagcaaatccgcgatttggaggattcgctgcttacacgcgtcattctctgtgttaacctctgtgatgaggcggctaaaaagggaattgaactgaatttcgatctgctttcagagaaactgaacatacctgtgattccatgcacggccagagaccgccatggattagacaaattaaaggaagaaatatatggagcctgcctcagcgcggcctgtacgagacaggagaggttaaatgatacggagagcatcaaagaagactgccgctgttcttccacttttcagatgtgcggctgctgccggaagccggatatgggcgaagcagaaaaccaaccggtatttcccgcttcctgcagcggatgtcccttctgctgctccggcacagacgggctggagctttattcctactcaggttccggccgtgaatccctgtcttccaaaggcagtgaaccggacgcctccacagacggctgttccgcccctgaaaaagcttccctgaaaacactgattcccgatttttctcctgccgcccttaccgcccaggccgtcacctacagaaatccggcttacctgaaacggcaggaacggatagatcgtctcattaccggccgttttaccggatccctgattatggttgcccttttgctcggcatcttctggctcaccatcaccggagcgaattatccgtcttccttcctgtgggatcagctcttcaggctggaaacctggctggctgccgccctcacggggatcggcgctccggaatgggttgtcagttccctgatatacggcgttttcagggtcgttgcctgggttgtatccgtcatgcttccccccatggcgatcttcttcccgctctttacactgctggaagatctcggatatcttccaagggcagcattcaatatggattgtgcctttaaaaaatgtaaggcctgcggcaagcagtgccttaccatgtgcttagtcaacgccggaatctaataaatcactttccatttcccgaacattccctttttgaaatgtgaaaacctccgtccggcactttcatttcccatttcaacagcgcgcctgtaatactgcgcagctttctccaaatcctccggtgattcgtttttgcgctcatagaggtagcccagctcgtaaaaggcatatccgtcgcactctgtctctgccgccttttcaaacaattctctggctctctcctcatcaatatcacatccatagcccttcatatataaaaaagccagcttggagtaagactgtaatgttcctgcattatggcactggtccagccaggaaaaggctttaacataatccgtatctaatccgtcctctccctggaaatacaggcatccgagtatctccatgcactccgcattccccatatccgcgcccttctcataccaggataccgcctgttctatgtccggtataccgccgattccgtcacggctcatattcccgagtacaaggcttgcgcagccgtccttttccatatcggccgcttctttaaacaatttttccgccatctggagatcctggatttcagacgccctcagatacagatgggcaaggggcagggccgtctgcttctgtcctgccgcataagcacggctgtaccagtaaaaagccttctcatcgtcacgttccaccacttcatccctgtagaaaatatttcccagctctgcaaagctctccggttcctccgccttagccgcctgttccagagcttcgacagcctttccgatatcacgttccgttccctgaccgttcaggtacatgcgccccagatgcagaaacgcctttagggccccctgtttggccgctgcttcaaaatattcccaggcagcctccatattcccgagattcagatggtgcagccccattctgtatagtccccaggcatttcccagcgctgcgcagcgatcggcccacttaagggccatctcttcatttttcggtacatactggccgtttaagcagcattttccaactttcaccatagcggaaacgatcccgccttttgccgcctgttcgtaccatttatagcaattctcgcgtttctgctcctccggctggagcaaatcgaagattgtctcccactcataagccgccgcgatctggaatgcggagaatgcgtcgccctcttcagcagactgaagcacggcccgatagctctcctccagggtgcagggtgaggctttcttaagctcttcgtcaaactggcctgcccttgccgcccccagcacacagcggacgcttccgccctctatgcctttcttgtaacattcgtatgcttttttatcactgaaaccgacggcgccgtctccccagctatagcagttgccaaggaaaaaccagccttccgcatccccggcgtgtgccgcttcttccaggtattcaatgccctgagggtacaattcttcattgcactgtttccatatcagttccacgcccttttcgcacaatcctgtcatcagtattgccatatgtatcaattcctctttccgtacttatccgtcttcacgctcatggcccggctgtcttttcctcattcaaaggcctgattctacaggcttatcatactatttttaccatgatgacacaactgtttttctttaattttatcactctgtaattgaaatttaagattccggcataaaatgttctgaacagattgaaaagaggttctttatgtatccatctttttctgacaaatcatttctgcccggagccatctatctgcgcctttcaaaggacgatgaaggcgccaaagaaagcttaagtattgccaatcagagaaaaatgcttctccgctacgccgcagaacatggtctgaccgtaatacgggaatatgtagatgacggctactccggcacttccttcgaccggcccggctttaagaggatgatcgaagatattgaaaaaaaggagatcggactggtgctgacaaaagacctgtcacgcctgggacgcgattacattaaaacaggacaatatacggagctgttctttccttcccgcggagtcaggttcatcgctgtcggggacggatatgattcagcgttctcaagcacggatttaatcccgttccgcaatgtggttaatgaaatgtatgcccgtgatatttcccgtaaaatcagggcttccctgcaggtacggatggaagaaggctcctatattggtaatttcgccccctatgggtaccgaaaatgcggaaaagagcgccatcagctgactcccgatcctgagaccgctcccattgtgctccgcctttttcttgatgcgtcccgcggggttctgccctcagcactggccgccgaattaaataatgaaaagattccctgtccgtctatctaccgctgcctgaagcatccgggcctgaatccggaccgcttcagccgctccggccagtggactgccaacaccattataaagatacttcataacccggtttatctgggtcatatggtgcagggaaaaacaaaaaagctctcatttaagagttctgcgtccctgaccgttccggagcatgagaggatccgggttcccgacacccatccgccgattgtcacagaacaattgttcctgcagtgtaaagaacagttaaaaagccgaacctgccggaagcaggaagctgacggggacgggcatcaatgaccactcatggctatgggcttcggctgtaacgctgccggtgttgtcggttgccggattatcgactctccccgtgaaagactgattgccatcctgaccaactccatggttccatgtaacggacgtttccccactctcatcatgctgatcactctgttttttatgggaatcggggcaaagagcggcggattccgggcatccttagtcacagccgctgtccttaccggttttattctcctcggcgttctcgccacgctgctgtcgtccctgcttctgtccaaaacaatcttgaaaggcatgccgtcctccttcacgctggagctgccgccttacaggcgtccgcaattcggtaaagtcgtcgtacgctctattttcgacagaactctgttcgtcctggcccgcgctgtctgcgtagctgcaccggccggcctcatcatctggctggccggcaacctgtttatcgacggccagagccttctgtcccatctgtcctccttcctcgatcccttcggccgctttatggggatggacggaatgattatggtgggctttattctggggttccctgcgaacgagattgtaattcccattattttaatgggctacctgcagacgggatgtctggttgaaatgtcggatccctctgctctgatgggcctcttcgccgcacagggatggacgattaaaacagcggtatgtatggctgtcttttcactttttcactggccctgttctaccacctgcctcacagtaaaaaaggaaacaggaagtatccgctggaccgtagtggcatttctgcttcccacggtcattggaatcattctctgttccctgattaatcttatattctgatttgtcagaacttccggcctccgccgccgtgcatccttccactgctgctcctgtgaagggttgtacggccggcaaagcttcccgggccccggccgcccgggccggagcctcccgtatttcttggtatccttctctgggtaaccatcttatttataaacatgtcattgaccacatcatacttgaaatcactgcttcccctgtatgaaaaatggtaattcagagactgtctccgctcttttttcatcttatactggtttattacgccgatacacggcataaccgccgcagccgccgctatggcagcggcaaaaagtatttcataccattcaagggacggcctgtagtctttcctgatatagtcatactgaccggcgggaacgccgtcgtccatgtaagaggcaatacggtccaccgccacggccgcgcacccggcataatccgcttccgatgcataaccgtaagcgctgtctaatacagcctcgatccgctcatccgtcagataatctgccatatctcctagagtggagatataaagctcccggctgcccatatcaatgacgatcagggcgccgctgtggctgcttccctctcccattccctgctgatcatagaaatcatctgcaaagctttccactgttttccggcccgtactctctgtcgtgaggacgcccagatccatctgccattcctcccggaaggaagacagcttctgttccagctcttctttttcacttgcgtcaaagagcttggcattgtcaaagacacgctgctctcctgcaatgactgcccacggcattgccatacacagcagtaccgacagaagaaccgtcaggaacccgagacggaggactttggcaaaactgttttttcggacggctgttctcatatcagataccctcctatcagcagcataatcagaaccggaaagaagacaagagcaaacagcccggccagccttccgtaatccacaggaagcacgccgcagattttgccgctctggccgttcattgcaaagtaatacatcttgtcttcctttttatccttgtaggtcaggacccagaccggaaggagggtatagccccactccggcgatgtgattttctcttcatggttttttacattgatactgtcatagccggaaatactgtttttcagggaagcaaccgcataatcgcggatttccgtctcaatttcttctgtaaattcttccttctccatgtcccggcgttcagccttgaagccggacagataaccggcctgaaagggcttcagcttctccatatcgaatggaagaacattctccgacaacctgcgatccgcctttttcagggcatttctggatacatttctgacttccatcagccctttccgctcaacctgatacctgctggtttccaggaattccatgctccctgttcttgtcgttctgcggcggacaccctcggcatcaatccggccgtccaccttacagctgtataaccagtagggataataaattccctccatcatctcaatctgctttggagaataaaaatcttttggaacatactttttacgcctgatccagcttttaaagatttcttccgccttatttcggtccatctcaaaagggacaacgtaatccggcctgtaacggccctccagcttccctgagattaccaccggattatggcagtaataacagaacgttgcggcagtcgtctcctcagtgacaatctccgctccgcagttgggacattggtaaagaaccattgccgcttcgctctccggctgtccggctgatgcttccgtcggttcttccggcggccgctccagttctccttctgtaaattcagacagacagtactcacacttgaatttctgcgacttcggatcaaataccagaccgccgtcacagttgggacacttatatgtaattgtattcatttctggcttcacctgcgcttcgattcattatccactgataccggttttacggcctgggttttccacattctgaacagaactttcccttatttatgctgccgcagctgcaggtccactctgctgccggcctgggtgaaccgcattcggaacaaaatttacctgtattgaccgtcccacagccgcaggtccagacggaaggctgagcaggagatgacggcataccggacggctgtgccgttcccggctgccggtccataccaggctgaaaaggagccgcctgattcattccctgattcatctgcatctgctgcatgttggcggcagatgcggctcccatgaaaccgccgcctgcattcatcccgactcccatgcccataaagcctgccatcgagccgtttgcattggaaccggccgcttccatcccccgggccaccgagccctggacatatccttcccggacagccggatctcccagcatcgccccctggtttctcatattaataagcttctgtgattcttcgtcgtaggaaatgcttgcaatccccaccgcctgaatttccattcctctcatctgattccagtcgcagtccagcgtggtagccatatactgccccagttcacggctcttcgaacttacaaatgaaattctcgtgccgtcagccgacatctggttaatcgaagattggagcgccgataaaaattccgccagatactgctcattgataacgtctatttcaacgtgatcctcattctttggaatcacctcggaatagaacttaagcggttccgtaaccttgattgaataggttccatgcgccctcagaaacagctcggcattatagaaattatcaaagtaattgattggcgttcttgtgccgaaacggattcctttgatttcctgcagattgataaaaaataccatctgttttgacggtgtctggccaccaaaccggattctgccgaaggtctccttcagtgcttccccgaaattgccgttaaacagcgacggcatggaggaattatccaccttatagtacccttcctccgcagtataatccacaaccttgccgccatccaccagcatcataaactgatttggatacacgtgaatcaccgaaccatttgacaccacatcgtccagtccttttttattctgcccgtttcttatctttacgcccttcgtaaagaccgtgcggtcgctcatatcctccgcctctataacctccagccactgatctgccagggatgttcccaatgcttctgctgccgctctgataattcccattccgattcctcctgtcccagccggtgcctccggcgggcaccgcttctgtcatgttattcgtaacagttcagacaaatgaactgttaccgttattccctgtactttgatttcaataatgcaatttcccttgcatatccgtcgagatcatttggcgtctccagataaaaaggcagttccctgagcgccggatgattaataattctgaccatggcttcaaggccgatatgcccttccccgattttcgcatggcggtccttatgcgcccccagcgggttcatgctgtcatttagatgaatcgctctcagtctgccaagtccgattacatcgtcgaaatggttcaggactccatccaaatcaccgacaatatcatatccgccgtcccaaacatggcaggtatcaaggcagacgcccatcttatcctttagctccacccggtccagtatttcccgaagctcctcaaattccctgcccacttcactgcccttaccggccattgtttccaacagaaccgtggtgctctgctccggtttcaaaatcaggttcagcatctctgcaatatattcgatccccttctccgttccctgcttcacatggctgccgggatgaaaattgtaacagtttccgggcgtatactccattctgtttaaatcatcttccatcgtctctctggcaaaccgcctgatgttctcatccgcagaacagccgttcagcgtatagggcgcatgggccagtatcttttcgattcccttttccgaggcaaatgcaagaaactgctccgcatcgtcgggatctatctttttagcgcttcctcctcttggatttctggtaaagaactgaaatgtccccgcaccaatcttttccgcttcctttcccattgcctgatatcctttagaggatgacaaatggcatccgattcttaacatggctgtctccttttttctctttcaaaacctctgaacttctcatgctggtgcgctttttccctttttccgtggattggcgtaaccgcatagattgaaatcgcaatcagaataagcgcaaggatcagctggacagacaggctcacagccgaccagtgatccatgatatagttgtccggcagagcgccgaaccactgttcaaagggcttacgtatatctcctgcgccggcctgtccgttaataaccgaatagaacgtcagagccgggttcagcaggagaagataaataaaacctcctgaacttgcctgcctggcggcggtgtttaagaccgaaacataagaattgacctcatttgcatccagacggtatgtaaatacattaattgcataagttccggccacaagcaggactatcgtgacataagtgcagacagtggcaaccgtagaacgcttcagcagggatgaataaaacatgccgattccccctgtaaacagcgctacgattccgtagcacaaaaacagtatcatcatatctgcgattgtaattccgccataaacaaacaccagcgactgtaccggcaaagcggatatagcgaggatcagcatcgtagtgagggccgaccagaatttacccagaattatttctttcggcttcattgtggtcgtcagcatcagctccagtgtctgcctttcccgctcgccgctgatactgctggccgtcaatgccggcataataaacatcagcattaaaaactcgatggacgagacaaaggtatacagctccaaaaaccgcgaatactgtatttccgccgttaccttaacctgctctaccaccgtaaacatattaaacagggcaactatcgccagtacactgttaaatatcagtaatatcagcgccatacggatactgcggctgctgacagtcagttctcttttataaaccggattcattttcatgtttcagcaccgccttctctccttcatgaccggtaatctgcataaacagtgtttccagactacccttttctctcataaaaccgctgatcataacatccgcatctatcatctgctgaagcagcatcgcctcgtcctgccggtcaccgataaatccaaccttaatctcatcttcttttaccgatatggtctggacgcagggatggctttttaatatggccaaggctttctctttattgctgaatatggatatcagcagcggatttgaggagttcaccctctcaaaaatctgggacatgctgccctgtaaaaccatacgtccctgctcaataatgccgatgctggtacacagttccgacagctccgacagcatatgggagcttaccatcagcgttttcccctgctccctcagttccttcagcatggtcgtatattccactctggttcttggatccaggccggaagccggctcatccagaatcagcaaatcaggctcatgaatcagcgccctggccagacaaagtctctgcttcatgcccctggaaagaccgtccacgaaaaattcagccttatcctccagctttacctgctccagcaaaagaccgcaccgtttcctggccatcagtccctctattccatagcatgatgcaaaaaactccatatattccgataccttcagattatcgtagactccgaagaaatccgggacatagccgattttttccctcagggctttgttattcctgacggcatcgacgccgtcaattctgacctccccttcgtccggagccagaaggcctgccacaatcttcagggtagtggtcttgcccgctccgttaggtccgacaaaaccaaacagctctcctttcggtatctccagatctaagccgtcaagggcctgaaaattgccgtattttttccgtaaacctctgatttccagcattatttttccctccctgtgacgtaaagcatcggaagctgtctgtcccagccatattcattcgtaccttcactgacatacttcaccgtcagcgtattggcaggagacagataaggtttcagttcgtcagccgtatagctctgcttttcctctatcaggtcattgcggcccgtatcataattatagaaatacatcttcccagtaaacagattcagatacgggtaccgcgggttattaataaataccggtgacaggggcatgaagtcaacctgcatgatttcgaggtcattacccagggaatattcaataatcgcaggttccgcaggctctcccgtgtacatactgttatatctcgcctgataatttccggatatcaccttcggatcctgttccatggccgtccggtaaatgattccgttcctctccctgacaagttccacctttgatgtcactatcgtaaggccttccgtaacaaagtcgtcttcttcaagaaattcttcctttttctccggattgaaagctacaatcgtggcttccggcgtatattcattcagatttgagtcgagataaaaggacagaagccggctgcgctcctgggaacgcatataatcttcgtcgtcgatatccgtcttttcatactgatcccctccggtaactctctgggccaaggcgtacgtgtaattcagcggataattcagaatctccaaatcgtccagttttacttcctgtccgggctccaagtctcccaggaggaccgcacggccgtagagaagcaaaaccgcatcctccagcctatgatccagccggttcgtgagtgttccctccagtttcccgccgtaggatatcactttgccgtcaattcccggattttgccttttattcagctgcttttgaagcataaacagctttggcgtaaaggcaaccgtatcgcgtatcttaatctccgttctgtccggaagataacagatgttcgttttataatcctcctcgcctgtaaagcgggcggcagtaaatgaatcataataataccccttcgtcaccggccgcaccgtatattccggattgagcttaaccgtatacggtttgttgtagggacttctgacgttgatataagtatcttcctccgcctggctgccggacacgtcaagtattgtagcatacgtaaaaaagggttccctgaatctcgttttcatccccataatatagatgatgccggtaaaaatcagtgcacaggcagttacgcctcccatataataccggtgaatggagcgtttcttcagataaagataaattcccggcccgatcagcatcaggtaaacaagaattataatagtatagagaataatattcggcagtcttcccgcatctccggtgttaatcagcccctgcacggcgaaataaaggctggcaaatcccgaatattccatctgggccagttcatttgttttcacttcccccatggccatcgtatagaatttctccatgaaggcgggatgtgtctcacaaaatccccggatatctttcagttcaaaagcagcgacaacaattctgccctcttttctgtggacataggaaagaagcggaaaagcatctcccggcatcagggtggccccgtttttcaggccgatgttcgcacagaccatctccataacggcatcctgaggggcattctgcgaatattccgctcccaggttgatttcctgcataacagcttcctcaagcggcggttccagaagctcggatgcaaaacgtcccatggcctctttgtaccttgctccccctccaatcagcagagttccgccattgtcaacaaaacggctgacggcctggtgctgattttcggaaagctggtttaaatcgtaatccgagacaagaatcatatcaagctgatcatagccgagggcatcctcaggagccgaatccttatcaagaaaaacctgctttattttaatggaaccatagtggattcccacttcgtccatgaactgaagttcttccggtctgtcactgaatacgccgacaaatgtttccgcaacatctccgctgatgttaagcttaagccgttttcggatcacctcacttccgctttcatccgtaatgctgacaaaaatctgatctgttttgattcccagaggaagatagacgattttttcatcctgtcccagggcagcaagggaaaccggatagtcataccggtacacctccatgctcgactccgtagtcaatatttcaagctttccggtaaaatccgattccctgcggttctccatctgaacctttatctgtagataacggttgcctttcgcagtatcatcaaatccataggtaacctccattccgacagaggattcctttcccgcctgggcggcagccagggtcctgagcggatgcagcagaactcctgccagaattatcagtgctaataaggcaaaaaagaggccataccctctttttccccgcgttatatattccttcatttctattcttcctttgcgtccttcggctcagagacacgctctacgccggcgtatcgaagttctctttgtttacgtcaaagtttgtcttaagcttaacggtaaataccgtgccgtttaaatcgctggtcacctggattgagccgccgtgcatatccacaatattcttggaaatagccagtcccagcccggtaccgcctgtatttgtggaacgcgactgctctacccggtaaaatttattaaatatcagcggaagttcatcagccggaattacatatccataattggtgaccgaaaccgtcaccgtcggttccgtaacctggatctttaccagaacacgttttccgtcagccccgtatttaatcgcattattgattagattatcgaacaggcgcgccagcagattcccgtctgcggtgatgactttgcccggcacattgctctgaagttcataggacaggtttttatccacgaagctcggataaaactcttccaaaagctggcttaacagcttaacaacatccaccttccccacatgcatcgtcatctttccgtaattcatcttggtaaatccgaacaaatcctcaatcagcttctcaagacgttttgattttgcatatgcaatatcaatatattttttctgcatctcctgggggatctgcactttaccggaaagcagctccagatacccgataatcgaagtaagaggcgttctcaaatcatgcgccacattggtaataagctcattctttgtccgctccgcctccctctctttgtccatcaggcgccggatatcttccatcatcttattaaggttcaccgccatttgagtaaactcgtcatcaccaatcacttccaccgttgtattcaaatcgccttccgatatgttctgaatggcggaagatatcttccctatgtaacgcagagccttttccagcagtgtcagaaatgtgacggtaaacacggcgatccccaggatcacatatatgagtaccatcagcgtattgatttccgtcatctgaagaagaaatgaatctgcgtatctcgtctctttcagataacttacaatcatcgatacattggcaatgagaaatacctctatcaggcaggttatcactgcactgtaaaatatattcgtaacgattttagtgcgaaaccgtctgctcatatcattacttttcaattttgtatcctaccccccaaacggtggtaatgatcttattctgtctggtgtcctctttcatctttcctcgaaggcgccggatatgtaccattactgtgttattggcctcgtataccttctcattccacaccttctcaaaaatttcatccgtgctgaacacacggccgggattggaagccagaagatagaggatatcaaattcaattggcgtcagtttaatctcttccccgtacactataaccttatggttatctttgttgataatcagtcccttgatggagatctcattcttcgccgaagagctgacattgctctgcgggtttaactgcgtgtatctgcgaagctgcgacttcactctggccgtcagttccagaggattgaacggcttcactacataatcgtcggcccccgttcccagtcccagtatcttatcaagatccgtggagcgggcgctcagcatgatgatcggaatattattcgtctccctgatcttcttgcacatctcaaggccgtccatcccgggcatcatgatgtccagaaggacgagatgaatcgtctccttctcaagaatgtcaagtcccgcctgtgcgttatccgccttgtatactttatatccgtcactgaccagatagatttctaccagttccgcaatctctttttcatcatccactaccaggatgttaatttctgacataaaaaatcctccctcattagtaatctttctgtcattttcccgcctttatcactctcaggaaatcatacagctttagtttaccatatggaaaggaattttgctttaaatttatcttacatttttgtcagatgtttcctcaactacgtgaggacgccgccgcaggctaacagacggggtggtggggtgtgtatatgagtctttcgtcccgggggaagattgccgtggtctggggctgcgacaggggcctccccatttaaggttggagacaatcagcgcccgaaacggaccatgaccggtgtgcgaaaaccttcgcctgagtcttccgtccccgtcggaaacctgacccggggaagtaggcggaatcaattgcggaggggacatgggagtccgccggtgcttagcgaggttcctcacgagcttagcactgcctcgtactccaaagagtgcaaacggtccccgcagcaattcattccggccggattcccccctcacgacaacctccaaaccggggacggaagactcagtcagcccctcgccacaccggacatgatccgttccggacgcgtcctccaaacctcagttaaatctctactgttccaatggaataaacaccctgtttttcaccgggtccgtcatctcttcccttgctttggcagcctggagcgcctcctcgcagaaaacttcctgggaaataaccagagttttgcctctcttatccttctttgcataagttccgtcaggctgtaaaaaatgggccttcacattgtcgtttaactggacatccaggatatggagcaggcgctctttcagcttctcatcctccaccggaaagagaatttccacacggcggtcgagattccggggcatccagtccgcacttcccatgaacagcttctggtctccgctgttctcaaagaagaagatacggctgtgctcaaggaaattaccgataatcgagcagaccgtgatattttcgctcagccccggaacacctgctttcagacagcagattcccctgacaatcatatcaatctttacccccgcacaggaggcctcgtaaagattggcgatgatttctttgtcgcagagggaattcatctttacgataattctggccggcttgccgttttttgcgttccgcgtctccctctgaatcaggcgcaggaacttgcctcgcagccacagcggggcgagtgacagcttattccagccaagaggctctgaatagccggaaagcatattgaataccgcagttgcgtcctctcctatctgcggatcgcaggtgaaaaggccgcagtcggtgtagagcttcgccgtggtatcattgtaatttcctgttcccaggtgaacgtaacggcggattccttcctcttccttcctgacaatcaaagtgattttactgtgggttttaagtcccagcaggccgtaaataacgtggcagcccgctttttccagcattttcgcccatataatattgttttcctcatcgaacctggctttcagctccacaagcacggaaacctgttttccgttatccgcagcctccgcgagcgccgcaataatcggggaatttccgctgactcggtataatgtctgcttgatggccagaacatccgggtcttttgccgctttcttgataaagtctaccacaggctcaaatgtttcgaacggatgtgttaaaaggatatctccttttctgatatttgtaaaaatgtcatcgtcattcatcagggccggcaccggctggggcgtataaccgggcgccttgagcgcgtcaaagccgggaagtccgtaaaccttcatcagaaccgtcaaatccagagggccgctgatttcataaatttcatcatttgtcacttccagctcatttttcaggatgtcaagcaggcgtttatccgctttctcttcaatatccagtcggattgcctcgccccactggcgttttttaagctgcttttcaatctccttgagcaaatcttccgcctcgtcctcgtcaatgctcagatcggcatttctcatgacgcggaaggggtgggaacagatgatatcgtaattcaggaacagcttgtcgatatttctctcgataacctcttccagataaatgattgtcgttttcgtctcattctgctcctggctctcgtccttcccgttcttctccccattcggtatgacaacgactctgggaagtccggtcggcacacggaccatggcaaaatccaactcgccgtcgccctttttctttctcaccagagcggcaatgtttagggatttattgcgaatcagcggaaagggtctggacgaatccaccgccatcggggtcagcaccggataaaccacttcttcgaagtatttatccacataaatcgcttctctcctggtaagattttcatggctggttataatcttaagaccattctgtttgagagcaggcagtagtcccctgttatatgtcctgtactgatctgccaccagttcatgcgtcttcactccgatagcctcaagctgttttgacgccgtcattccggctatatctggctttgtatatccggcatggatcatatccttcagtgaagccacgcgcaccatgaaaaattcatccaggttggatgccgtaatgcttaagaatttcaaccggtcaaacagaggcgtcgtcttgtctctggcttctcccagaacacggtagttgaattccagccagctcaattctcggttaacataattttcaggactcaaatatttggatgatatctctgccatcgtttagatcccccttttctgtctgagtaccggacggataccgaagatttcctcaaagaaatctgccttctgctcaaaggaaaaacgttccagtacaatactgtccgtatagccggtcgttacaaccaggcttccttccctgaccgccaccttaaaatctgacagtttttgtttatgtcccctgtccatggagttggccagacgcaggatagcggtcagcttggcaatgaggatggtcagttcccgtctggatatattcatgcccccatggcgggagaaatcagattccagaatcactccgtcgtaggcaaattcctgaatattataccgcacgacattggctacaatctcccgctccaggtgggacaggccgataatctccgtagccatgataatctgataggcattttccgtactttttgtaatgctgacaaatttcccgcaggcatgcaggatggcggctatctgcagcagcagcctctcccggttgctcaggccgtggtatttcctggttgcgttaaacagggccaccgccgtccgttccacctcctgggtatgtgcggcgtagcatttatacctcttggccatattgcgggctgacgacaggatatcgccttcaaaatcatggtggaacttaatcagccggctctcctccgcatattccgcggcaatgccgtcgcagagccggattcccggaatccagacagattccgctcccagcatatccagaaccttcttgtaaataatagctcccggtatcagaagagccgcatagtcatgctcaatctcataatagtcttcaatttcgtccacagacatggaggtcagctttttacaaaacgccttaaactgctcggctgtaaaccgatccctgtttgcctccttcatcccctttttgaccatatagatgatactctcaccggtggcaatcaggttcttaatctgcctgtccttcagatacatcttcttaaatgtataaagctcgttatccaccagttcgtcaatcacctccggtatcatgtgataattgaccttccagtgcgccgccatctcactgagtcgaaggactcccagaatcaggttctgggttgataccagggtatctttgtcaaacagggatatctgggagctgccaaatcccacatccacaattgccgttcccgtctgtacggttttctgaaactccgcatctttggaggcaaccgccttgtatgtcataaacctcagttccgaattattaatcgggattacccgcacgccggtccgtaccagaatctgatccagaacaatctggctgtttctggcctccctcagggcgctgctggcataggccctgtaatcctgcaccctgtaggttttcataacctccataaactccctgaggacctggcacatttcgtccaccagcacatatgtgatctttccgtcattgtaggtatcttttcccaaagccaggacatggcgcaggtgatcaatttccctgatgccgtacttaccggaaatctcgtatattcccagttccagctcaaatgatcctacgtcaattgcagcaaatgttttaatggccatactttcactcctccagctttaatttacccagcaaatgagtgataaactgggcggccgtccttcctgacaatcctccgtggcttaactcccatttatttgcctccagatacaattcttcctccggtatctccacgtgatatttatccgccagaaccttgacaatcttctgaaattccttcttatcgggagaaccgtaatatattgtcacgccaaaccgcgctacaagagacagcttctcctgaaccgtatcgttaacatgcagctcatcgtccagctccctcttgtcgctgaatttctcccggatcagatgacggcggttagatgtcgcataaatcaggacattctgcggcttaatccccaatcccccttcaataattgctttcagatacttatactctatctcgtattcctcaaaggaaagatcgtccatataaataataaatttataatttctgtccttaatctgttccagaacatcggaaagacttctgaactgatgcttatatacctctatcatccgcaatcctctgtcataatatttattcaggattgcctttatgctggaagattttcccgttccgctgtcaccaaacaaaagaacgttgttggcagcccgtccctctatgaatgcctcggtattctcaatcagctttgccttctgcatctcatagcccacgagatcttccaggccgatatgctctaccctggtaatcggttcaattaccgccctgccgctgttttcattcatattaatgtgaaacgctttattcaggccgaatttaccgaccccgaattcccgatagaattccgtcaccgtatcctggaacgccgtatcatcttccgtgcgctccagcgccgccgccagctccacaatccggttgcggattctccggttgaagaccctgctctcctccgaggtactctcgtaatttttcatcagctcccagattccgccggattcttcatccagaacagcgatatcgctggaaaacagttttctcatgagacggaaatcatgggccgccagcacattaagcgtgcctcccacagggcctttaatctcacatgacgtgctgtaggcattctcatggttagccatacagaatgctaaaaagcagtgccatagatttcctttaaaaccataggtcactgccagttcaatgagactattggcgcaggcataggcatccgggctgttgtcgcctttttcggatgccagaagtgtgcatacatcgtcaaatagtttctgatattttaagtttctgtacaggatcatctgattccctttaattatctcattctctttccttattctttcttccatgctgccctctttccggctgtaaagtctcatcaaatcaataattgcccaggattctcatattctgcgcctcccgggatattccgtagagtgcgttgatgactcctggattctccagattgccttcaatatcaacgaaaaaacggtattcccagctccggccgggaaccggccgtgattcaatcatcctcatgttgacatggttgaagataaaattgcccagcatattgtagagggaaccgcttttgtgggggagttcaaagcagatgctgatcttctccgccccctctctgtacaccggttttcttgacagaatcagaaagcgtgttgtattatccctgctgttattgatcgcctccgccaatggtttcaggtcataaatctcccctgcaatttcactggcaacggcagcctgtgtcctgtcattctcatcgcggatctttttggctgccaccgcattattttccatgctgatctgctgccatccggctcttttattcaaaaactccgagctttgcagcagcgcctgtggatgggcatatacgcgcctgatgtcatccagcgttgagtccttcgttcccagaaggaaatgttttaccggaacaaaggtctccgccactatgtaattgtcatacctcagaagcaaatcgtaattgtccgtgacgaaaccggcagaagaattctcgatgggaagcactccaaagtccgccttatcctcctgaagctctatcatcaaatcttcaaatctgcggacatgatgtatgtccgcgtcttttccgaaatactgaatggcggctgcatgcccataagctccggcaagtccctgaaatgcaacacgtctgcctgccgtatccagctccgaaaccttctggaatcccagctccgtaaggccaatccgccctgccatagtctggtactgatagcgccggctcaaggtcatcatctgaaggaacagctcgccgactgcctgtttattaaagtccccctccgccataccggtgagggcttctatcttttcctgttcccgctttgcgtcatagacaggcttccctgtccggattttaaactccgccacctcaccgcagagcctcattctctcttcaaacagattttcgatctgcttatctatttcatccaatttaattctgatttccgctaagtccatgctgctccttttcaagcattctgattatctgctttcttgtataagccccgacaaacttccgttcctccggaggcagttctttaataataaacggctcgccaaattcaatcgtaacttgagccggttttatgaatggaagatgtttttcaaatacctccgccgtaccggtaatcgcaaccggaactaccggacatcccgacttctcggcaatttttaagcttccttccttaaaaggaagcagctccaggatattatctcctctgttcctcgttccttccgggaatatccagatggagacccccctcttcactttttcaattccctctaatatcgtcttgagtccttctttcaggttcttcctgtccaggaacaggcaatttacgttagccatccagtctgaaagaaacgggtatttcttcatctcttttttggctacaaaacctaacaaatccggcaccgtcgtatagcctacgagaatatcaaaataactcctgtgatttcccacatagagaacgggctgccccgccggaacattctccatccctttcacggttacgctgactcctgatactttaagaataaagcggaacaccttttttacaacccgcagactttcccgttccatcttctcctgatcggtcctgccaagcttcttcatcttatgcagatatcccgcggagaaaacaagaaaaccaattactgttaatgccacaattataaaacgtatcattttcttcacctcgctatctgttctattatataaaaagaatggcgcttttacaagcatttcctgtctgtaaaatgcctgtaaaacctgaggattgttactgttcagacggggggctgagatctgattggagatttagttaagcaggtgaggacgccgccggtacggccagcggacggggtggtgggattgttttatgagtctttcgtcccgggggaagattgttgtgagttgggactgcgggcgaagataaagtctgcggagcacgctcccgctctgtgaaatgcatcacgctgctaagctcggcaggacctcgctaatcagcgatggatttcaacggcatccgcagactttatcttcccctccgccccaagggcagatatttcgccgggacgaaagactcaaggccaagggtatcgcccgtccgctggcctgcggccgctgaatgtctcacgcgttaagtgtgtgggcggaccttgtcgcggccactcagtgctaccgtgtacgggaaatacgatataccttcattgcgcctttataaaaggcgctagatttggtatctgcctgcggaaacacgtagtggccgcgacagggccctccccatttaaggttggagacaatcagcgcccggaacggaccacgtccggtgtcgaaaacctccgcctgagtgttccgtccccggcgaaaaactgacccggggaagtaggcggaatcaattgcggaggggacatgggagtccgccggtgcttagcgaggtcttttcgagcttagcattccgatgcgcactccaaagagtgcaaacggtccccgcagcaattcattccggccggattccccccctcacgacaaccttcaaccagggacggaagactcagacagccccctcaccacaccggacatggtccgttccggacgcgtcctcccaacctcagttaaatctctattttagtgacagcgacccgtctgaactgttactgggtattcaagggcatgcagccattaataaagaagacctgacgccacaggcagtcagatccttctttttactgtattcctataaaagaggagaaaggaggcggctgcactgctccttaaaacgtatgatcagcccccttgcctcgtaatcttccggcgtaatctcccggcaaaatgccaaatcacttaaaaatgcctcttccagacgttccgttgtttcctcatcgtaaataacggcattgacttcaaagttcagctcaaaacttctgatgtccatattcgccgtaccgtaacagcttacaaatccatccacggaaactccctttgcatgaaggaaaccattctcataggtataacatttggctcccgcccttaagaggtcgcccacatacgaataggtcgcccagtatacaaacggatgatccggtttgcagggaatcatcagccgtacatcaacccctgaccttgccgcaatctggatagccgacaaaacggcgtcatccggcacaaagtacggtgtctggatatagatgtgatgtctcgccttgtgaaacagttccagataattgtcacgaatctggcgcgtctgcgtatccggcccactggaaataatctgaattcccaccatactgtcaatcgatgtcggctcgggcattccgtcagcctcgttaaaataacgcatgtccttaaacagattttcccctgccgcataattccagtcctgcgcaaaacggagctggaggccgattaccgcctcgccgtatatctttaaatgggtatcgcgccaataaccgaacttcggatcttttgagatatattccctgccgatattaaagccgcccacataaccgacccgtccgtcaatcaccactatctttctgtggtttctgtaatttacacggaagttaagccggccaagcaccggcggaaaaaagcttgcaataccgataccggcttctttcagcatcttccactttcttttcggcatgaaccgaccgcccataccgtcatataaaattcttacctcaaccccgttcctcaccttgtcaagcaggatcggtatcatggaatcaaataattcatcgttcttaataatgtaatactggatatggatataacgtttggcgttttttaattcttcttttaaatctttgaatttttccacgccgtcggtaaaaatctcgacatggttattcagtgtcagaacggaaccggccacctccagattataaagcaccagatcagcataaccgccggccagagagcccagaagccccatgtcctggctcttgataaactcttcctgattgcgggcagagtacctcagccggtcctccacctctttgattcggaacatcttgctttttctgaaatcctgatcaaaaaataaataaaagaggataccgaacacaggtatgaaatacaaagccagcagccatgtccaaaccgttttcggatcatgcctcctgaaaaatacaatgattattgatagtataagattgacgaaaattatatgatccagcagccatgcccagacagacacggccgtatcatatatggttgatattacgtccactgtgctcactccgtctcttgaattgtctcagggtgggtcccatctatccctgttactatgccgggcttagtggggataataatcttctggcgctttttcaccttgactttgcctgatgcttcgaccgaaataatgtaatcttttacttcgtactcaatacttcttaaattttcagcactactgtcctttacaaatccttgccctgcaagatatgcctctttggtagctttattcgttagatatggataaagaacatgtctcggtgaagaaaccggatagtccccaagaatttccgtcagtttctctcttgatatcactatccccgactcatccagatccatcaggtaaaactgcagcgcacggaagacactcttcgcctctgtaatataacgctgttccctggctttctcaatatattttgtgaaaacaggcgctgtgacacctgttaatattaccagcactgatactgaaatgaccagctctaataatgtaaatccacaattgtttttcctcttattcatcatttgtctgtcgctcatgatcaatgaaatctgttttgctctctgtcataagaaaaaccggcatctgccagtttttttactagttcatcccggttaatcatcaaatcgtcacacaggagatccagactggaataaaaatcccggagctgcgtattcacatagctcagacatataatggggtcttgtggtatctttttcatattgggtcacacttcctttactgtcatatttccttcactgtcatactgctatttcccacacactttatcacaataccattgtaaattcaattgtttctctacataattttactttttatgacaaaatccgccattattgtgaatgttttactcatcttcaaatataaccgtgatatagaaacctctgtcattttcctcgatttttttcacaattccctttgtcatcccgttctccgtcttcagacggttattcagcttaaaaagtcctgacatcgccacagccggttctatcatgtaattgacattaaagggggtaaccgattcgctgacctctacttcctggccttcctctaccaatcccggcctttccattttaaatactatctctctcgccatcactgaccttctttcatcctatccatactattctatgtttccacatctacgcattcaatattccgaatacgcagctgcttttaagtttatcacgaaacaaaatattttccaatactcataagccggtatcctttacttatacggacaaggcacagagcaattacagctctgtgccctaatatatatctctgcctattcagctatctgccggccctcctggtccagataaaagttttctttccaaatcagttcggaaaccgttaccagctcaaaccccttttcctgaagcccggttatgactgcatccagtgcgtcaggtgtatattttgccccattatgcattaaaataatgcttccgttgcccagatgaggattattcagaaccatatccacgattgaatcggcgccgtagtctttccagtccagactgtcgacatcccactgaatcggataataccccatagaatcagccatctcaaccacctgattattataatctccataaggcggacgaaagagtgtcatatcttttcctgttagttttttcactttatcgtgtaccttttgcagttccattcgaatcactgctttgtcaagccggctcatatttttatgattttcgctgtgatttcccagttcatgtccctgtccggctatgtacttaacatcctccggaaatttttcaacccagccgccggtcataaaaaatgtaaccttgacattatgggcgtccaggatttccatcagccggtgtgtgtcctcattcccccatgcagcgtcaaaagtcagtgcaactttgggggcctccgtcttcacgctgtaaataggaagctttctttccttaatttggtaatttcttcctgtggtctttatactcttaaacacactttccgaagaaacactcgatgtttcctgcttgtgcagagacttttcatacaaggatgtaatacatccgatagacaaaaggaggagcagcatccagaaaaatgcattttctgccaccggcagacgaggtcctggatgctgtcctgacatatcactgcttttctttgaaaaaagtttcataagccacctcaactgtatgattatttgcaggaatctttatgccgttgcaaggcactcgggcattacagggcaggatttcagcatttctacgttaataacagtatatgtgagtatccgctcagccatgatgtatttcgtgaggtgtttttcgcaaaactcccgaaaatcattacatgcctattgacattttcacaccttagtgatacagtagtaatatgataatatcgtttttaaaattataatatcgttttttaataacaagtatttcttaacaaatttcgttatttatatgaaaggggtttttattatgcagaataagccaattatttatcagcccggcgtagtgccgcaggaaatttacagtggagttccatcttttatgggcctgccggtagctaagacggccgaagatgtgaaaaattttgattttgccgttatgggcgtaccgtgggaaggcggatgtacctatggcggattctcatcctgtgttgtggcgccgaaaacgttccgcggcgtatcgacaagatatacaggttaccttcctgactatgatattgatacatttgactatatgactgcctgcgattacggcgatacagttgtacagaacggcaattatgatttaaccttcgcaaatatgcgcgaaaaattcggtgaaatcattgatgccggcgccattccgattacatttggcggtgatcactccatctcctacccaatgatcagtgagatggcaaaacgccataaaaaaagggtgggtgtaattcattttgacgctcatctggacacgatgccgtcctttggcgatgatctctattccagatgttctccgttcaaccgtctgtatcaggatgaaaactttgattctaccaagatcgtacatatcggaatcagaggaccgagaaatcatccgcaggaaagaagagaagcagaaaaatacggagctactgtcattccggctatggaaatcaagaagaacggatacgaagctactattaaaaaagcattagaaattgcatcgaaagatacagacatgatttatgtaaccatctgttccgatgtcctcgatgcctccgccaaccctcagggaccggtcgatccgtgcggactcacctctttcgagctggctatgatggtaaatgaatgcggcagagccggagctaatgcctttgattttgttgaaatttatcctgaaacctgcggaacccagatgtcggctcacacaggtgtttggatggcgctctactttatgaatggtctggctgcaaaaaaagcagagaaagtacagaaataagcagccgccactccgcaaaaaataaggagaaaattccgccgtatcctggaattttctccttattttttatggtaatggaatttgcatggataattccatccgcatcctgcattattttagcaacaggttttccgatacaaactctgcgcattctctcataggaaccacaacatcctgaatgattggcatgacaatcgaactggaagccactatactgaccgtaccgtaaagtccgcccgtcttcttcataatcggtatggcgatactgctgattcccagccctatctcttcgaattctgtggaataaccccacttttctatcttgtccagctctttttgcagatcttccttggtcacaagcgtatttttcgtatacatccgctgatccagtgtcttgaaataacgctccctctgacgttctcccatatagtaaagcaaaagtttccctgatgcagtcgcattcaatgcaaacgtagtattcaaccgcgtaagaagtatataatgggcattttccggattaatattttcaatcgtaaaaatattgtagttggaaaccacctgaagcctcgccgatacctgaaatgtattggaaagctcctccagataaggccttgccattttcttcactctctccatatcattggcgctgaccaaatctgcttttgggataaaaacaggacctaatgaatagatgttcgtctcactgtcatgttccaggtagccatttgccaccagggtatttacaattcctcttgttgtattaatatttaatgaaagcatctcgctgatttttggtaaagtcagttttggcgactgttcgctgaaacagttgataatatcaaaagctctttgaatcgactgaatcagacgcacttctttttccataataaaggctcctcttctcttaaaatcaagatggttttattttacaacattttagaaaaatatgcaatgaatcccttccttagttttctatttcccgcatcagtccagaagtataaacggttactgtctccccttattccatcggcattttccccggatatatttgcatttttctccgcctctccggcatttttacaggtttttctgataaattacaataaaatttatactaatatgataatttttcttgacactgcaataacggtcagttataatgacattgtagttattaaaacgatattatcatttactgttaaggtaacaaattaactaaggaaggttgagtgtgatacatatggaagaattattggagcgtctcctggaagaatgccgttcctatacccggcttggaaaactggccgactacattcccgaactgtcaaaagcagatattaatgattttggcgtttatcttgtgaacagcgacggaaaagaattctatgccggcgacttcgacaaaaagttcaccattcagagcattatcaaacctctcctgcttctaatggcactcatggataacacaacggagtatgtcagacaatacataggtgtggaagcaaccgggaaaccctttaatgccattgattattcagaacagctgattctgaaagagcatattaatcctatggttaatattggagccattgagatgtgctcgatgattcacggcgagacatatgaggagcgttttgaccgccttctggcctttacaagaaaactggccggaaatccggaaatcgatgtggatgaggccgtatatctttcagaaaagagaaccggcaataaaaaccgggcgctggcctatctgctgaaaagttcaggcattattgacgacgatgttgaagaaatccttgatatctattttcgtgcatgttctatccgcgtaacctgcaaggatctggccaatatcggttttgtactggcaaaccacgggcgggggaaaaagaccggggaagttcttttttcaggacgccatgcgcgctttgtcaatgcaattctcaccacctgcggtatgtatgacggctccggcgattttgcaatcaaagtaggcctgcctgccaaaagcggtgtaggcggcggcattatggccgtatctcccactcgaatgggaattggtatctattcacccggccttgataaaaaggggaacagtctggccggtatccagatgctggagcagttaagtgaaaccttatacctcagcatgttttagttctttactatactgattcgataaaccgtcttaattggaaatggaggcaatgcatggaaaaaaataaaacctatactcttaaagataagtgtaaagctctcggcccgggaatccttgttgtaggatcctttatcggcccaggtaccattacaagcgccacgagagccggagccacttatgggtatgcacttctctggactgtaattttctctgttatcgcagtaattgttatgcaggaaatggctgcccgtctgggaatcgttacccagaacggacttgcagaagaactggtgaaagaactctccgaccgccctccgcttaaatgggccatgattattctcgtagcttcagctatcgtgctgggcggtgttgcatatatgggcggcgacctgacgggtaccgctatcggcatctcttccctcaccggaattccttccaacatcgtagctccaatctggggtatcggtgtcctgatcctcattaatataggcgatgccgtaaagactcttgaaaagctcttaagcgtctgtgtcagtgttatggctatcgtattcgttgtcaccatgattattgtaaaaccggatctcggagaactactgatgggcgcggttccgaacgttccgcaaaatgcaattatgacctgcgttgccatgattggcactaccgttgttccgtataacatgtttatccatgctaccagcgcccggaaaacatggcataacccggaggaactgccgctggcccgtttcgacgttaccatatccatgatcatcggcggtatcattacaggtgccgttatgattacagcaggcacagttatgcgcggtatgaccgtttcatctgccgcagatatggctgttcagctggaaccgctcttaggcagcttttccaagccatttctcagtatcggcttgatctccgcaggcgtttcctcggcagttgtcacacctctcggtgtttcctacgtacttgccggactgtttaaatggaaaatggataaaacagacaaacgcttctttgccacaaatataatcgtagtcgtaattggaattattgtatctgcaacaggttacaatccgatttcaattatcatgatggcgcaggccgttaacggaatcttccttccgattatcgttatcgcactcgtattcatcacaagccgcacccgtgttctgggtcagtataaaaactctctgctccgcaatcttctgggaggatgcgtggcaattatctctctggtaatcggtatcagcagcgtgatgtctctgttttaattaaaataaatattatagcatatccgattatctgcatgatgataaaatcagcaagggagatgggcataaaaaatgcgtatctcccttgtcatttatatatattaaatgaaatgatgttggagtcaaaaggtcttttgacccctttgataccggattgctccgcactgcgtgctctcacaatcctcaaaaacattcgcaatccgctcatttttctgcggaaaatggcttcttatctgtcatcctccccggccctgccggccttttttaccagccaaaacagtatcagcgcagcggcggctgttgcaaaaatccccaccgatacctgtaatcctcttttgataattttcaggaattcagtccatttgtccaaagctcccggttcagtctccccgtcaggtatgtccccgtcctcagggacagccccctcctccttttcttcccctccgtcggcagcctccccgtacaccatgctcatccggtatctcttaaaatcaggcatctttaccgccgcactataaagggccgtgcaatcccataccttctgccgccccaatatcagaacgtcacggcatataatgcctccctcgtcctcataaggctccccgtcccatagaaatgcttcaatcctgtaatcctccggctccattcccgccgccttaagaaattccccctgaaaggaggacagctccggcgtgtccgtctgacgcggaatatgtatgtccccaaacagatagtaatctgccccgtaatcatggaaggtggcggtgaaggaaattccggcctgccatctctcattgctgtattgaacctgctcaagagataactctgcttcaaattccttcccgctctcctcatccttcacagtcataaccgccgtatccggcacagtatcgagccggctgattcccgggtagtccgcctggcccgacagctttcttgtgtccccaacaactgggactgttagcagctcctgcttcttcagcctgtatatccggccggattcactcttaataaactcttccggctgcggaatctctcccggcgtatcaaacagatctgaaaatctctgtatttcttcctgagccagaacccggcacacatccttccggcataaaaaaactgccagaaagcataatattccgatgcacaggcctcctgcttttatcccctttttcacagcgcacctccccggcggctctccgcttgttcctgattccgtaccatctccggtacctgccaagcctcaagcgttcttttgtatccggcgcttcctgcaccggacgttccatattaatattaatcaattcaagcagcagttcttgctctcctgccagatgatcttgctgccagggatactctttctccgatgtttcctgccagcaaaacgtaatttcactgtatgcctgttcaagcattccgtatttcgttataatgtccctcctctctgccgcattgtttatgtcagttgtttcaatcataaaattactcattggtatttgtttcagaagtacttcagaatttttgaaatatagatattagtaagatgaatctgatttttgccgcaaaatgcctgcttttcttatatatgcgcaaaaacagaaaaaagttaaaaatatacaataaacgattctaaaattatcactggctgtggaagttcctgcgattcgcattctggaattcagaatagattccttatccggagcatgattttaagatagttatattattatacaccctgacttaacgaaatgcaagtaaaaaaagaatataattgctatttttctttccctaagatataatagagccagaaaaacattgtaaataaaggaggctgaagatggatttcacctataacccaaaccaaatagctttactcggagaagacgataaactgctcgccgaggtaaccttcccggagattgacaaggatacggtaaatatcgaccacacctttgtagacccgtccctcagggggcagaatctggcagacaagctgatgaacgcggtcgcagagcaattatgtgcagaggataaaaaggcggttctgacatgctcttatgcggtaaagtggttcgataagcatcctgaatacaaaggcgtaattaaataatacggcatacggtgcccggcatgggcgccgtacgataagaatgattgcgcaaagcattttatccgactgctgccaaacgcaaaatgaacagctggaaatgcgtcagcatctttccaactgttcatcctgcttcttctgattttcctacttaaataccaccggctcttccatgaacggcatcttcactacaataaacggatatgagcattccgaacccgtctgctcctgcttctcaggccctttgagctctgttcggatcgtgatggaattctctgtcaggtagagttccggaacagctatactgtagcctcccgttttctgttctccatacccggctgctatgtacaaatcttctcctcccgagtaagtcagcctgaacggttcttttttcttctgttcgattatttcctgaagttcctgcggtacctcattttgccccacgaccgtaaattccagatcccggaccttcgcctcctccttctcaccgccgcatccggccatcagaacggctgacagaaagagcgctgcggctaaaatgactccatgccgcttaccactcagaatttttcccataaaaaaagctccctgttctttttgattattatcattctattaggaagtctttctttttattaccttttcgccgccttacctttttaccgtatttcttcccgcaaccccgcgaacagttcaccgtcatcaatcaggaaaggctgcgtcctcctgtgagaacgcagcctttcctgattacggatgcctgtttccggataactgcctccggatatgatactgccattattattttctgctgcatgcctgaagctgatgctgatatttttctttggtagccataccgcctctgatatggcgctcagccttattgatatccagaaccactctggcctgcgccgccagagacgggttgatattctccaggcgatcggtcacatctttatgtaccgttgattttgaaattccaaatttccttgccgtctgccgcactgtcgcattgtaatcaataatgtaattcgctatagctaccgcccgctcttcaatatattctttcaaaaggttgccccctgaaatcattgtttttacaatgtatgcagcggacaaataaaacataccttgatccaggttaaaaaaaacggatgatttttcacacacaaaagcgggacccctatgagtcccgccccgcgttcaaaaagatttcaaaaagagtacaatcatatcaggaaacctggtttatttccatctattcgttattttttcatgcacgtcgtaccacatttcagatgcatcaaagctgccgtctttcttgttgataaaacgatatgtataaacattattatcgtaaagctggatgaacggaatcgtcacataagcatcatcatatctgccgtcttcatcgacatagtcgctggttgttgaatcggtatttaatgacattgcaagaagctgtgccgcagtatagctcgttcccttaccttcatccagtgtgatggacttaacggaactgtcggaattaaattctaccgataccttatcctcggaaatcgagctgttttcaatattgtagcccttcttgcctttctggattttgcccttgctgtttacaagataaatcttatcattgtagaaatacagcctgttttcatcatctgccgtcagcttcttaccgttaaagtacagataaccgctcttttcaccgttatagccctgtcccttctttcctttgctggaattgaagaaaaattcgtagctgtcatcgtcacagtctacactggcgacttttccgaataccgggtatccgctttcattaaagtaatagaagccctggtcgtccggtgaatactggagtcccgtcaggtttcggccgtactcgtcaaaggcataaaactgcttgcccatcttctggctgtcaaccttgatacgttttacataaacaagtccgtcgtcatcctttacgcgggcatccttggcggaatcagcccgtttcacctttccgtttttaaagaagtaccagtggtcgtcatcgtctgtctccgtatccacggaaccgctgatttcataccagccgtctgctctccagccctcttccaccacatttgcataaatcatatgctctatctgtgaggcgccaggcgttgccgcatttccatccagggccgcattcgactggctgcccggagctgctccggaaacctttctgtcgtttatccactcataaagcatctgtccatgctcattaaaataatagtaacggccattgactttcttcttgtcagtatctcttgtgagctttccgccggaaccaaagtagtaccagccctcgtcatcacagggatccgaactgtcatccgtacagtcgagagcgttggccgccgcattatcatcttcatctgcattgcccggacgctcaagccacagccactggttatccttgcgggttccgtcgtcctcgtctccaagatagtagacattgccgtccttttcataccatccggtcgccatctttccgtcttcatcgaaataatatgttttcccattaatttttttggatgttgatgtcagcttgcggcctttgctgtcaaaataataccagtgatcaccgtcttcaccgggatcatcgatgctgtcgtcggacggaaccttaatccaggaattgacaagcctcttacctctttcattcacatagctctcatcgtccacccaggacattgtcagcatatcgccgtcatcatccaggtaaaaccagctggtaccatcttttctccactcactggtaaccatattgtcatcggaatcataataatgccagattccagaatcatctttctcccagccggcggcgaaagaagtcatggaagctcccatggcaagtaatgctgccgtagagagtattgcgactaatttcgtttgtttcttcataaataaaagcacactcctttttttgaattcttaatatttcctgagatcggttcggaccgcttcgcatttcggagcataccggcaatcccgttttcaggataatttaatcataccgggaaaatcttaatcaattctaaaaccttttttaatgattctaaagtaaataatttgtaggaagtatgtcctaaaatgtaagaaaaaattgaaaaaagtaacaattgaatatggtataatgagcgggtgtctattggaatttctttccagatacccggcactactgacggaggaaagcgaaatgggtaatgcaaatattttaattatagaagacgatgaagatatccgggagggcataaggatcctgctggaaagtgaagattaccgaatcacagaggccgccgacggctgggaaggattacggcttctgtcagatgatacggatctggtaatccttgacatcatgatgcccggaatctcagggttaaagacgtgtgaagaaatccggaaaacatcatttgtcccggttctcttcctgactgcaaaagcccaggaatctgataagctgatcggcctgatggcggggggcgacgattatctgaccaagccgttctcctacgcggagcttctgggacgggtaaaggcgcagcttcggcgataccatatctaccgcggcaaagaagacgaagcatcacagccggaggaacacttcatcgagtccggccgtttccggattaatgaggattttaatgaggtatatgttgacggtacggaggtcaatctgtccgatatcgagtaccatattcttcttattatgatgcagtatccaaaacgcatcttctcagcccagaatttatatgagagcatctggagtgagccgtatttttattcatgcaatgccactgtgatggtgcatatcagaaatcttcgaaaaaaagtggagaaaaatccgcagaatccggtatcgataacaactgtctggggaaaggggtaccggttcgatgcctaaagataaaacacttaaaacgaattcgatttattaccgctttctgaaacttctggccctggccttcgtgaccgccgctctttttttcctccttctcaatcagggcggagagaaacttctggattactattttactaaaacaaattatatggagcgggaaaatgcgaggagatacaatgatctgcgggattacgtaaagaaaaacaaattgtccacggaagacacggacaggctggccgaatgggtccgccgtcaggaagtcgtctggatgcagatgtaccgcgatcacattctgctttacgactcgcagttcccctatatgaaagccaatccggagtatcatgtaacgggccagttctacgaatggaacggttatgaaatgatcgattttcaggatggggaggcactcgtcttcctgacaggcatgtatacataccaattctttaattatgccctgatcgttgaatttcttctctccttcctcctgtttaccggaattatcatggcaggtatccgaagtacaatgaaatatatcaggacgctgagcgccgagatcgggattctggaaggcggaaatctggattaccgcatcacagtaaccggcagcgatgagatggcggttctggcaaaggggctggacagcatgcgcgaatccatccgtgacaagatcagccaggaagccgaactgatacgtctcaaccagtccatgatcaccggcctctcccatgatctgcgcactcctttgaccgcgcttctcatctacacggagatattaaaaaatgagatcgatgcagacagaaagcagatgcaaaaatgggttctgaaaatagatgagaaggcacatcagattaaagatatggccgactgtatcctgaaatactcccttctgaacaaggccgccggtcccacggctctcaggcaggaaccatttcgttccgttttctacgactccctttccgagttgtgcgtctgtctggagcagaaaggctttgaggtccgtccatccctggcctgggaggacagggagatctgtgccgattcaaaatacataaccaggatccttgacaatatctgctccaatatcataaaatatgcctcctgtggtgacccgatccggatcgaatcgttttatcagacggacggctgcggcttggtgtttgaaaataaaaagtcggccaaccagacccaggctgaaagcaccggaatcggtgtccgcaatatccgcgaaatgatggaggagatgggaggatgttgtgaggcggaggagacatcggaggactatcggatccggctgacatttgcctgttcccccgccgtttagacaaaatggccagccgaagctggtcattttgtctactcaagcgcttccaaaaactccctataccccatcagcttcccaatcttcgggaaaatccatttttcacagaaatcctgttcttcctgtgtatcggtggcggtacagtcgccgattacaatcacacggtagcctttatcataggccgaacgggcggatgattcgacacaccagtccgtgtgaaatccggtaaacaccacatactcaatctcatttgccctcagataataatcaagggcggtggagtggaatgcatccagcgtctttttgccctccaccacgacgtctcccggctgcggcgtcagttctttgataatctccggcccaggcgttccccgaagccatgcaccggttccccagtctgccttcatatccatctcaatcccgcgaagtccctcgcacgccggaccgccttttttcagttccggaaatccgggatcaaagggatggaacgggcagtaaaatatttttgccaccctgcctctggcctggtttaacagttcctgaagatttgcaatcacatgtctctctgccagctgttccctgatatgggcatacatggtgccaccctcgctcaaaaaatcattctgcggttcaattaatacaattgccgtcttatcctttggtattttaaaatctgccatatcaataacccctctcttttaaattgaattttatatctgcctgcatacgccggtgtattcaaaaaagaatacgcggattacattgcattcggcaggaacagcacaatctgcggcacaaaaacacagagcaaatcgacgataataatagccacaaggaaccacatggagcctgcgaaaatctcattgaccgtaatgtcttccactccctccatcccgtatagggaggacttgaccgtaaaaacgttcatgccaaacggaggcgtaatcatgcctgtctcaatcgcaattatcataatcaggccgaaccacaccaaatcgtaccccaaatcagccataatcggacacatcaacggtgttgtcagaaggagtatggaggtggaatcaagaatacatcccaaaatcatcaggatcacgatgaacagtaaaacaaccccgataggaggcatatgcaggctttcaacgaaatccctgatcacattaatcactccgcacattgccagtgtctttgaataggtcgatgcggaaaccagcagaattaaaacacttcccgatgtggagcctgccgaaagcagagtctcccagaagtccttcctgttaaacctctttttaagtactacaatcagaaaagctccgaatgctcctacaccgccggcctctgtgggggtgaaaaagccgcaccagatgccgcccagcgaaacgataatcaacagtacaatcggccacggacgcaggacaatcttccagaaatttttctgctcttcctccgtcaatttctccacctccggaatataatccggcttcaaatgggctaccgtcaaaatcacgatgacaaacgcaattgtcatgatgattcccggaaaaactgccgccacaaacaattttccaatggagacatccgcctgggagccgtaaacaatcatcaaaaggctcggaggaatcagcatacccagaatggcagaaccggagatagttccaagcgcaacctttctgtcatatttcagacgcagcatctgaggcagtgctatctttgtgaagactgctgccgacgctaccgttacgcctgtgatggcagcaaaaatcgcatttgccacaaccgttgcaataccgacgcctccccggaccttcttaagcagaagactggccgaatcatataagtcctgactggctccggacaggttcgccagaagccccatcagcacaaacaggggaatcacgccgaacatatactgcctgaccgccccccatgccgactggctcagcacgttcatagccgtcgagaaccggccggtaaacaggaatacactgagtgtactggtaaacatcagggatgtactcaaatgtacgccgctgaaaatcaatgccagcagcaggattaatgaaaatgccgctacaacacctgtactcactgtacactccccccttctccataaaaactcctgcctgtcagcaggctgtaaccgtactttacaatctgatcgataaactcaagaatcataagcgctgagccgaaaataatggcaaaccgccccggtaccgtcgtcacgcggaaggaacccgcaatctccgcttcaccgatgctgatcgcgtggagcagattcccccagcttgccctgataataaatgagtagaccaatattccaagaaacgccgccagaatatcgattataagcttccccttcgccccgaccttgtcataaagcatagtggtccgaacatgggctcccttaaccgccacataaggaatctccagaaagcatacgatgataatgatactcgatacaatctccgcggttcccacaaacggcttattaaatatgagacggctaagtacatccgcggtgattaaaatcataattacaaaaatagaaacagatgcgattccatccataatacccagaaaacgttccagcatcctgtctatccttcgcagaatggtcatgagttccccctcccctaatcaattcttttctgtcggttcttaagtcagtttccaatattccagtcgcggatcctctcaaccccgtgggattcgagaatctgataatatttttccacaatttctgctccgttgtatcctgcgctgtccaggctctttacgagaccattcacaatatccggaaggctggccgcccatttttcctgttcttcacggctcaatgtgacaatcgtgcagcccttagcctccagctccttcagatcctgctcgtgaatctcattaatataatttgcctcgtaatccaggtacccttcgccaacctcggtgagaatcgtgcgtacctcctccgggaggtcattccatgtatccatattgactgtgatcgcgttaaacggaaccacattgaaatttgcatccagataataaggcgccacctcataaacctttaagtttacacaggaatgcgtcggctggattgtcgcctggcatacattcgtctggaggttctggtatgtatcgttcagggacgtctgaacgccgaccgctccggagccttctatccaggaaagattaattccggccgctcctattttcatccccttgacatcatccagggattttacctcttttgtactgtagaagccatatgggtctgaaacgccgattccaatgaatttctgattataatccgtctcgtaggtcgaggtaaattcaggatactccgcatacatctgcttgaccgtctctgcgacaatcagaggatccgaacaggagaaaggcatgctgtaaaccatatcctgaagcggaagcctggatgcttcgaatacgagaatcgtacatccgatatccaccagtccgtcctgtaccccctgtagctcgttgccgagagaaattacggagcctccataggatttaacccagtctatctcataatttgtctctgcgctgaccctctccgtaacattctttacaaagtaatcctccagcgccgtaatccagggattcgactccgaatgtcccgaaccgattctcagggtaattttctccttgctgcctgaaggagccgctgctgtggaatcaccctgtccggccggagtttctgtctccttagtctgtgaatttttgcttccgcagcctgtcatcgacataaccgccactgccgccgccattcccaatgcaaataacctgtttttcttcatttttcccatcctttccaacctgcaaatatctcttttccttcacgatgttttgtttccattccgttggacaccggatattggatacaattttatagtgacattgtacatcttcttgtataatttgtcaataaacttttattttgtcattttatatttatctatatttcacaataacaagcttatattttggatacattatccaatcgattgacaactgccgttttttggggtatatttatctctggaaaatactgtaattacgatgagggaggccattcatggagaataacacaccgttaatccaatatacaaccgtttcagattccgtctatctttggataaagaatgcaattattcagggcgattttaaacctggggaacatatcgcccaggaaaccctgacgaaaaaactgggagtcagccgcacaccggtccgggatgcgataaagcgcctggaagcggagggccttctgataaccaagccgcactgcggagccgtggtcttccagctttcccgtgaaaatctgaacgaaatatacgaggtcaggatactgatggaacaatactgcgccacgcgtacctgtatgaaagcatccgatgaggagattaacgccattgaggcgatcaatctgcgcatgctcagtttctccaatacttcaaaagaatttatgcagttggaccgtcagttccattccctgctctgtacactgtcgggctgcaccaatacggtagagattcttgagggactctggaacaaatgcgattctttcaaatcaatctactattccctggaaggcagggtcaatgacacgctctccgaacatacgcgtatcgtgcagggattgagaaaaagggatattgcagcgacgaaagaagccatctcggcccacctgaaagatgtggtcaacagtgtcggcgcatatgtaaacttttcctgataaaatccgtaacaattcagccgtctggcgccgccggccggacatgcgcccacaggcaaagagcccgggaaaccgggctctttgcttattttcctgatgataatatagaaatctgggccgtttcctccacaagttcggccaaataggcagcttccctcatattccttccaaacgtcacctggccgtgccccctgagcagaaatgcatttgctccgggatttcgggcaataaagtccagaatctgcggaaagtattctgtgggaaccgcataggaatgtgtgtcaaataccggcactcttccgttcagcttcagtttggaatggtatgtggaaaactccagttcatcgtgcccggcagcccaggccgtcgcatagggggagtggcagtgcataatcgcgttgactccctctgacgctctgtagatggcgccgtgaagcagcgcctccttggaaggacggataccgccctctgacgccactgcgtcaaagccggtgactgcaagcgtctccggccccacctcatcaaaagcaacatccgttcctttcaccagcattaaatctcttccaggcaggcgcacgctcaaatttccgccgttgctcatctggtagcggagagcgtagaattttgccgccgctttctgcatctcctgtgccggcccctgatattctgaataaagcatctcttctcctttccccttaaacgttacagttcagccttcggccaaactgtagcaaatgatgcacagaaacggcaaaaaaacgccgtttcgcgccgcataactcgggattttcgcaaaaaacagtgaaaacacctcgcggaatacatcatggctgaactgttatccttaaactcctaaaagccccatcatttcctctgcgcagacgtgggcaaactccggatcacaaaaattcaaatcgtatgccttgaatacgatttccggtttaaggccctcttcaaaaatctccttcattttctgaatcgtccctggtttgtggaaaaattccccgggataactgagcgtgcgcagaccgcccatcggaagtatcacttcagtttttcccgcggagcggttgagacgctctacaatggttcttgttatatctaatatctcattttcatataaacgtgtatgggtcaattccttattatgccatacatagccgcggttctccccgtcttcaaagagttcgtccgtacgcagacaggcaaaatctattcctcccgggcagacgagggccggtatccccatttcagcagccgcacacagccggttttgcgctcccctgctgtatccgtagccgccaaaatactccgccgtcagctcatgcagggacaaatccatcacagccgtaataattccttccctgattaaatcctccatcactttaccgcctattcctgtggaatggaaactgattatcttcttaccatgttccgtcagttcattggaggcctgcatcacggtatcattggtaatccccatcagggtggcgccgatatacatctccccccttgtgtcaatcccccggctcccatgggagaccattccaatcattgcgctgaccgtattgccgagaactgcttcactgatgggattcatgccggcaaaatcgacaatagacggcataaccgcaatatctttatcccccactaccgtatcaaaacaccgggaaccgctggcaatggtggaacagattatctttggaaaaccgatgggaagcagccgcagggcggcggagcatactacggtattctgcagaccgcccataccaatcactccgtccatctccccattccggtacagcttcatcaccgttttcgatatactctctgtcattgcaaagatggccccgcttttgtcgaagccgtgaatctgttcccaggtataccctccgttctccaggatccggtcccggctgatatctgcctccatgggaatgttgggtcccgtactgatgtccagtatcagcggcacattgccgcttctttttatcttttcccgaacaaatgaaatttcgtgatatttagtatcacagcatgctataaccgcgattaccgccatataattcgaagtctttccgacttcttctttcacctgccttcccgttccaatccaagcacaggtgtcacggcagcacggacaagcatctccctgtcatgacacgtcagtatcttatccgggccttccgcccgctccttaatccgctctatgctcttccatgcggcgacaatatcggaaaaacggtttggaggcgtgatgtcgtagtgaagctcctctatcggttttacattatccataataaaaatcgagtcgccgcagcagatataccttccggcggccgtatcgatctcaaccgactggtgccctatcgaatgcccgggtgtctcgaacacgcgcacccccggcattatctcggtatccccttccaccaggttcatcgcaattccctcaaaaggcctggtaatccccaattcgggagcctcgtaagatttaaaatacagcggaatcggattcatcgcaaattcatattcttttttattcacgtaaaatttggcatttgtaaatttttccatataaaagcagtgatcccagtgaaggtgggtaaatacgataatgtcaatctcctccggtttataccccagagctgcgagctgctccacaatcgacattccctccggctgatgggatccatggtgatgatacttgtcggcgcgctctgtgtaagccatgccggtgtctaccagcagcagcttgccaccgccctccacaagataagtaaagaccggatattcttcctcctgatcagaggcctccggatagaatgccaccgtagaatggtggtaaagatactgctttgggatcatcgtcacaaagccggtattgataggccgtacagttaaattactcattgtgatacctcctgatattgttattggggtatccaatattgtatccagtgtccaatctgattataggtgatcagaaatgctttgtcaagatttgattttttcatcaaatttattgacagaatcctgttatagtgttaaactttagtagtttaaagttcaaaacttttacgtattgcattatcagaatcagcagccgaaaagactgcctgtcaggaaaggaaactattatggaacaaatacatttaaaatatggcacgtcaactgtggattttaccgtcgaaggcgccaaaagcatcgcttatctccacgagaatccaatgcgggtaattgatgatataaaggcggaattccaccactgtatcacaggcggagtcatcgggaccaaacccttaaatcagctaatcgcaaaagaggatgatgtcacaatcatcatcagtgacatgacccgtttctggatgcgccaggatattctctgccagcttctggtggaatatcttcatgatacgctgaatattccctttgaacagattgcggtcgtaatcgcactcggaacacaccgtatgaattccgaggaggataagaggaaactggccggagcctatgtatatgatcatgtgagcgtaaccgaccacgactgtgactcccccgacctcgtctgtgtcggcaccacctccttcggcacaaaggtcagtgtcaatcccctggcggtgggcagaaaagttatcagcatcggcggtacggtccatcatatcatggcaggttacggcgggggcagaaaaagtatagttcccggaatcgcatcacgtgagaccatccgtatgaatcatcaaatggcgctggatccggaacagccgaaatccgattcccgaatcggaagcggtaaaattcttgttaatccgattcaccaggatatgtgcgaggccgccgatctggttcatgtgacattcggaatcaatattgttgtggattctgcctccaggcacagcggacttttctgcggagattttgacaaggcgtggaaggagagctgccgttatgtacagcagtcctacgggctgccgattgattatgaggcagacgtcgtaatcgtaagctgcggcggatttccaaaggatctgaatttttaccagtccactaaatcgctgttcaacggggcgaaggcggtaaaaaagggaggaaccctgattctgctggccgcctgctcggagggcagcggggcaaaagacttctttgactggatcgagcctctcaaaaacggctgcctcgatgaagccctgagaaaggatttcactatcgggggatatatcttttatgctgcctgtgaatctatccgcaaggcccgtacgcttctcctctccggcctggagcccggggtgataaaggatatgcaggtacagtcctttaaggatatggacactcttttgtcaaaggtggattttaaaaataaagatgtctatatcatcccttacggcggcagtgtcatgccgcagttaaaagaagaatatgcagagctctgcagcaacatataaaaatagcctggcaccagccggaaggagtatcaccatgaatatacctctgataatcgtaatattatacgttatgcttttatttgggatcagcatttatgtctcccggaaacagaaaaaggacaaaaatgattttctaatctataaaggaaaaaataatacctttattgtggccgccagcatctcaggccttgccatcggaggggcgtccaccatcggaatcgcagaaaatgcatttacagtgggtctgtccgccggctggtacgacacagcctgggctatcggagccgtcgtatcctccgtactggcggtgaaatatctgcgaaaaagcagctactccaccatcagcggtcttgtaggcgacctgtatggacagaaaaccagctttatcatggtaattgccatgtgcatcatccaatcgggcatcattgccctccagtacaaagcaggcggttctatcctggcctctctgctcccggacgtcttcacggtggaaagcggcacctttttctcctttctgatttttatgctggttgccgtaatcggaggaatgggaagcgtatccctgaccaacgtactcaacctcattctgatttatgcaggcgttgtcctggccgctgttctggttttacagggccacggaggctggactgccataaaagcgctcacagcggcacagcctgatgtaccttatctcagtttaaccgcaggaatgggctggattggcattataagctggattattgtcatgatgggcaacacaaattctgtccagggcgttgtacagatcggccttaccggaaaagatgataaagcagccagaaacggtttcattttcggagctttactgatggttccggttggttttatatgcgcaattttaggcgtggccggcagagcgcttcttccggacgcttccgcgtccatggcgctgccgatgattttgatgagtgttccccccatactcggcggaatcaccctctccggcctgtgggctgcggatatgggaaccggctgttccatgattatcggactctccaccacggtcagcaccgatatcgtatataaattaaactgcaacaaaattccggaaagcaaaaagatgcttgtaaataaagtaatcgttgtcctcagcagtattataacctacctgattgcgacacagatgggtgcaatcctggatgctatgcagaaggctttgtccctggcgatcggaacctcctttatcgttatcggagggcttctctttcccggattttccagccgtaaagcgggcttctggacaattatgacatccatcgtctcaatcattgcctggaatatagtcccggcgctgactcctgtattcaaaagcatcggtctgtttatgcttgccacctgcggagccgtcttcattataatcagcctggtggacagtgagaaagtaaaaggaacatccgccgttatcacaacagcaaagctcgcgcagactgccgaatgattaattgaggctaaaaaaccaggcagacggaaaccgcttccgtctgcctggttctatctctatacaattgtgctctgctatctgattgttgagtagccgaatgtattaacaagagcatccaatttctttccggctttacactgcggacagttcctgtaatcggaatattcataatccggcagatccttcttgccgaaaactgccttgataggcacaccgttcatctcgtcgatagcgctgaatatggccgatactcccatcagaataccgtcatagtactgaatacactcgattgccttatttacggtaaggcccgtcgtaacggaggccatcaaaatcatcacgtgtttcccgcggatcatcggtatcaggttctccctgaaaataatctggctgttattattaaactccggacttacaacataaattgtcttatgagcattcatcgaaagaaatccgccctgtgtcagctcttccgaaagaaacgctcctatcacttccgtctcttccatgcatacaatcgtatcgattaccgtgtcatagagatacatgctgaccagatccttagccagctcctgtgcctcactggttctggtcttcatcgtggtcatatcaatgtaataattgatatgggcgtggttggttgcataatgtcccggcataactttcagcgcgacatcggttcctgctgttttgatttttacatatttgttctccataaaaacgcccccttcatgaatgaagtctccttgtagttcacctatattatactaaaaatcccggtctatcacaagttaaaatctgtacatttatacaattttaatcaaattttttaacactttagataaagagatttaactgaggtttggaggacgcatccggaacggaccatgtccggtgtggtgaggtttttgctgagtcttccgtccccgtgggaggttggtcgtggagggggaatccggccggaatgaattgctgcggggaccgttttcactctttggagtgcgcatcagtgctaagctcgtgagggacctcgctaagcaccggcggactcccatgtcccctccgcaattgaatccgcctacttccccgggtcagtttttcgccggggacggaacactcaggcggaggttttcgacaccggacatagtccgttccgggcgctgattgtctccaaccttaaatggggagggccctgtcgcggccactacgttttttcggcaggctgatatcatatcttccgcaattctttttaaaagcccattgaaagcatatcatatttcccgcacacggaagcactgagtgcccgcgacaaggtccgcccccgcacttaacgcgtgagatattcagcggccacaggccagcggacggggtcgatacacttggcggagtctttcgtcccggcgaaaacctggccttggggcggaggggaagataaaggctgcggatgccgcctaaatccatcgctgattagcgaggtcctgtcgagcttagcagcgcgatgcatttcacagagcgggagtgtgctccgcagactttatcttcgcccgcagccccataccacaacaatcttccccgggacgaaagactcataacccccccccagaccgtctgaaaacctcattctgcacataaaatcagcctcttttctttttttgtgccattgaaaactgaataaatcacacattttaaaagaaaagaagctgcttcccttaccattaactccatcattcttccgaagcccaagaggttttttgctctttctatattatatcccaagcaaaagagtgcaaattcccctgccaccttccttaaccctattaagagaaaataggctgctcccattgctcgtttgatggttccaaacggatgctcggacaaacacatcctctggcacattttttcttgacttggcttcaatgtaaattttactacctttactttttcatatcggacttttgtttcctgcccgctttgctgatattccttcccctctgcttccaaccactctttacaagctttctccagcgtatcctttgtaaaatcgatttctttccattcgttttttcccttataacacttgtttctatttttgcagtgtttacaggcatttttattcgtataccggatattcccgtttttcttgatacatttctgcctcaaaatctctcccgccgggcagtaaaccagattccgttccggatctctgacgaaatatccctctttcgcccgctccaccatctcatctgtcgttccatatacggatttgactttcttttcctgttccgcttccgtctttacctttctgcgaacttcttctacccgcatatctgaaatcacttctttatacgcttccggtatctttcccgcgtgaagacttttcttcaattcttcccgttttatgctggcggtatctgcctctgctttttcataaatgagttctaactcatacccgcttttcccttcttccattattacatgcgggatgatcccattctccagacaacggatgatatcctctgcgttctcatatcccttgtcggctacgacttccaggatctgattcccgttttcttcccggagtccctccatggttggggtcagcattccatgatccgttacctgattcgtcattttaaaatcccgtatcaaatgcgtttctgaatctactgctgtttggggattataggataccgcaaacccatttttatttttcataagtctcgcatccgcatccgtcagcgacatctgggacgcccctgtttcttccattaatctctgataagcttcatatcgagcaagacgctcctgggcttctttcagttttccctctattacttcccgggtgagattttccggcatttcttccaattcttcctgttcatctatttcctttaggagacgcagatactcatctgtgtgggcatttagccacttaatccggtcatccagcttattttttgtgaaatgattgtccttggaattgtttgcctgaaacttacttccatcgatcgaacaaaatccccaatccaccgcactcgagatccttcggttgaattcatggaaaatctctttcatactgtctatgttatcttttctgaaatcagaaattgtgcgaaaatccggttctgctcctcccatcatccattttacctcaagattgactttacagctttcagccagttttcgtgaagaacgaattccttttcgattcccatagatatacagtttatacatcccttttgggtcataacccgggcggccttccctcgctacttcttttattccgtattttgtaagctccagactgttgacaaaggcatcaatcagcctcgcgatactctccggagccacgaaagaatcccaggaacacatcatcatctgtgtacggtcaaacgtaggaatatatggcataatctgtcacctcgaatacgatatttactcgtttctattatactatgtccagcaccgaaagtcttgttttctgcgtgatttattcagttttcaaggtacaaatgattctatatcaaacaccccattgagggtggggcagccttatggcagcagagcgttcgactatcctagttttcagacagtctcccccaccaccccgtccgctggcctgcggcggcgtcctcacctgcttaattaaatctccatattttctctcacacaggccaaaaaacgttccccatacttctcatacttaaattcacccacgcctgatacctgcagcatctccgcccttgtctcaggctttacaatacacatatgggacagcgtcttatcagaaaatacaatgtatggcggtactttctcctccttcgcaatctcaaaccggagtgtcctcaggcattcaaacagcttttcttccaccccgctaaactctgctccgccggggactgcggcaatgctctttctgcccttctttttcccgctcttttccctggccggaatctgttcctttgccatcttcataatcacctgttcatcaccgttaaggactgactgtgatttttccgtcagcttgacaagcatatattcgtcattagtcacccgcaggtattcattgagcagcaggtaattcatcacctgacgcagcttaaaggcaggaactttgtcaagcttcgcgtaccaggcattctcgtccatccggtactgcctgatcttcgcagtggaggctccccgcaccgtatcaagtattacattcacgccataccgctgacggcagtcctccacacagccaatgaccgcttctgccacctccgtcacgtccaccgtctcaaactggcttaagcaattggaacagttcccgcagtaattgcccccgtattccccaaagtaccggagaatataatctctcaggcactcattagtaaaacagtaatacgtcattctgcgcagacgttcccggtctctctcctttacaagctccctggcagcaaaatccagctcgtcgttgtcctggttattgtcaataaagaactggttcgtcaccacgtcctgcccgccgtacagaagaatgcattccgccggttcaccgtcccttccggcccgcccggcctcctggtaatagctctctatatttttcggcatattataatggatcacaaagcgcacatccgatttatcaatccccatgccgaacgcatttgtggcaaccatcagactccttctgtcgtaaatgaaatcctcctgattgcgcttccgctccgcatcactcagccccgcatggtagcgcgttaccaaaaatccctcttttgccagcctgccgctgacctcctccaccgtctttctcgtcagacaatagatgataccgctctgtcccggatggcattctatgtaattcttcattgtggcataccggtccctcggcgcctgaacggaaaaccacagatttggccggtcaaaccctgttgtaacgacattcggctccctcagcctcaggatatcgatcacatcatcccttacttctttcgtggccgtggcggtaaacgcgctgagaaccggcctcttcggcagcttgtcgataaattccatgatttttaaatagctgggcctgaaatcctggccccactgggacacacagtgcgcctcatccactaccaccatgactatctctgcgtgaatggcaaaatcaaggaactcctccgttaccagccgctcgggagcgacataaataatggggtatcttccctctcttgcgtaagagagcgctttataatattgatttactgtcagggagctgttcagatacgcggcatgaatgccggcctggttcagggcagatacctgatcctgcattagagaaattaatggcgatatgactaatgtaattcccttcatcattaatgccggcacctgaaagcataaagattttccggcgccggtaggcatgattcccaaagtatcccggcctgcgagaatactgtcaatcagcccctcctggccctcccgaaactcttcatagccaaaatactgttttaatacctgatatttatccatatagtaatctcaatctccttttccgccgtctgcattctgacagaacctgattccatctgcacgcccaggttatttctcaaatccggcctctgcaaaatataccggcagatggaaatccggcgtcccgctttcaattctggaatagctcatataatgttctatctccggactttccgaaatcttataaaaattacagtacataggcctgttaccgtctgccgcaagccagtcctctgtttttttccctgtcacttcctccagataccagtccgggatcagaaaatcaacgcgccatccgtctcttccgatcaccgcattgcatctgctttcccggtacacacgatccggtataaactctctgttcctgcgtccaaagccgtactgggcatacattgccgcattggcattgatttcaaaattcaggtaaaggctctcattggtcaattcgccttcccggccgtcctctgagaccgggaacgccagaaacagctccagcgcgctgtccttccagaccgggcccttgtggtagacctgcactctgcagggattcgtctcaccgcaggccattctgacaaaaaggcccttaccctccaggtagcccatataggcccacgcctccggctgcagcctgccgttccactgcacctcattgattccggccctttcacatgattcaattgctgtctgtgttttaattctcctgactgtatatctcatctttcaatcatccttcccgagcattcctaacttctctaaggcataggcgattccatcttcctccaccgtctttgtcgtgaagacagcatacggctcaagtccgctgtcatgcttccccatcaaaaccgagttgagagaatattggaacatcgataaatcattcatactgtccccaaatacccaggcatcttctttggcaattccaaatctcccgagtaccgcttctacggccgtggccttggaatgccccagcggtacgcattcataaaaaccgccgcccctgtcaatgatttcaaactcatcttcaatcgtcgcaaaaaattccatcttccggctttcccggtccgctgcgacacagaatttggagatatcataggaattatcttcccatcccagcggcacataggcattgccctccttcagcagctccatcaggcggtttaccatcggcatcctggactctccccgctgaaagtagcagccttccacgccttccagtaccccgtccagaccaaagcgcacgatatcttccttaagtctggccgtccgctccgccggaatccgcctgtcataaatgacttcattccctgttgtaatgtatgtcccgcagccgcacagcagaccgtccgattccacttccatttgaatcccggccgtctggcagactgtcctccccgtgttaataaacacaagatttccgcactgcctggttttttttaaggcaagcaccgcgctctgcggtacctgcctctcaatctcgctgaataatgttccgtctatatcaaaaaacaatgcttttctattcatttctgaacacaatctctcctgtttcatcatccatgctgtcgacaatcgccagcgactcgagacggattcccttttccctgattctctttccgccgtcctgaaagcccttctcgataacgataccggctccggaaagctctgctccggaatccttaatcagggctgtcagtccctccagcgccttgccgtttgccaggaaatcatcaattacgagaaccttgtcgccctcgcccagaaattcctttgacacaatgatgtcataaaccgttccatgagtaaaagattccacctttgtcgtatagacatcccctgcgatgttcttcgtctttgtcttcttcgcgaatacgacgggaacgtcaaagtattccgccacgatacaggcaattccgattccggatgcctctatcgtgagaattttattaatctcagtgtcggcaaagcgccttttgaattccttgccaatctccctgaacagcccgatatccatctgatggtttaaaaaccggtccaccttcaggacatttccagctttcactactccgtctttgcggattctgtctaataagatctgcatatgatattccccacctgcttttgtatgataaccgccgctgtcattgccttctttatgacgccggagccacgtctccctttgcaaccgtaatttccgcattctctaccaggaagtccagtgtcttctgcatcagagccgtgtcatcaacgatttccttatcggcagtttccagaaagctctccaggctgtcatatccataccgctccgccagagcctctctgtcctcatctgtgacggtgatattctccctggaagcaatctcttttaacagcatctcctgcttggtcatatccctggccacatttctcagttcgctctttaaaccttcctcgtccattcccatcaggctggcataggttgctaaatccagaccgtacatcgacgcctggtttgtataatactgaacctgagtttcatagttcttatccacatcgtccgttgcgcatacaatctcagatttatcaataaccgcgttgagaatgtcagtatttctctggttgtcaatctgatactgcttctgctccagaataaatgctttcatgttttctctcagcttttccacagttccgtcttccggtgaaaccttggcaacaaaatcgtccgtcagctccggaactgttttttcttttacattatttacctttacctcaaatactacggcctgtcccgccagatccggattattctggtatgggtcagggaatgtaaggttcagagttacctcttctccctttttcgctcccacaagccctgattcaaatccgtcgatgaagctgttggaacccagcaccagatcatatccctccgcagtgcctccgtcaaaggcaactccgtctttcattcctttataatcaatattaacctgatcgcccagctgagcctcgcgatccacctccaaatactcagcgctcgaattcaaaagctgctgaatctgagcatccacttcttcgtccgtcactgtcggttccgtcacggttacaggaattcccttatactcacccagtgtaatgctgccctcggcaacatactcttccgtctcagcaggtgtctctccttcagccgtgctctccgcctgtgaggcgtccttggcactcttttgtcctgaacagccagttgcaaacatcataagcgcagccgcgccgcaaagtcctacttttaaaaattttctcattcaaaaatcctcttcttttctaatttattaacaaatctgtcccgcaaatctgcccaaacgcattctggagccgatgcgtataacagacataataccacaaacggctccagaaaaaaagatcctatttataaaatgcgcagaacgctttatatgtattgtaaatatccagcttggacgccaattcaaacggggaatgcatcgaaagaatcggaactcccagatcgactacgtcaacatccatgcctgccacatacatggcaacggtgcccccgcctccgacatccacggctcccagttctccaatctgccagtatacgccttcgcggtccatcatatccacaatctttgccatcgtctcggcgctggcgtcattgctgcctcccttgcccctggaaccggtatatttcgtcaggacacagcctttattgatataacaggcatttctttcctcataaacctgtgagaaggtcggatcataggcggcgtttacatcggaagacaggcagatagagttcctgagaattgtcctgtaatcaattcccgccgtctccgccaaatcttcaatatagtgcagcacgaaatctgaatccagcccggtatttcctacggaaccaatctcttctttatcggccagcacggttaccgttgtgtattcaggctctatcgatgccatctcagccgtcagcgccgtataagcgcacactcggtcatcctgcccgtatgctcccaccatgctcctgtccagtcccacatccacagccttgaatgccggaacgatctctatttcagccctgataaagtccttttccgtcataccgtatttctcgttgaggacagagagggccaaaagcttcaccggctcctttatatcctcatccgcgctaaacggcagagagccgattatcacattcagttcttctcccttgatgccgtccttcagcttgcgctcattctggtctgccgccagatgggggagcaaatccgttacgcagaagaccggatcgccttcctcctcaccaatacggatgtcagtaatctctccatcctttttcaccaccacgccgtgcatggcaagcggaattgcagcccactggtacttacggatcccgccataataatgggtcttgaaaaaggccatctccgccttctcatacattgggttcggcttcaggtcgagacgcggcgaatcaatatgggccacattcaggcgcacgcccgtgcctatctccctctgcccgaaggttgtcataatcagggatttttttctattgacataatataccttatctccggccttatagtctctccccttttcaaagggcgcatatcccgcttcattcagaagctttaccgctgcctgagtaaactcgcgctccgtctttgcacagtccagaaatgccttataagcctcacaatattcgaacgcctcctccttctgggacggagcctccttcgctatattgggaaagctccaggtcagttctttctgcagttcttttaccttctccccggcagtcagttctgttttctctgtcagctctgttttctcttcctgtatcattgctttacgttcctccttcttctctgccgttcttggcggtcttttctatatccggaatttagcgccgcctgcttcaccgtctacgcggagcagccggtctagagcgtgtttgaaaatccatttctgccctctcccgaaaagtgtgacgcacagccgacagaaagcaatttacaaacgtgctctaattctttttcttctttactatcatatcactgtccagaacaagtgtaaacggtccgtcattcaaaagttccacctgcatataggctccgaactctccatgctccaccttatccacatacatcctgcaccgctccaccacgtgttcatacagccggtttgccaaatccggggcccctgccctgaaaaagctgggacggttgccctcgctgcagtccgcatataaggtaaactggctcaccaccaggagctggccccccacatctgccagcgagcggttggtctttccgttctcatcctggaaaatcctcagtttacataatttatcaaccatcttgtcggcgatctcctccgtatccgtatcggagacgccaaggagtatcagaaagccgtcatctatcgctcctattgtctttccctccaccgatacactggcttttgatactctctgaagcacaattttcatcgtctgcatcctccttactctattttaacatctcccggattctcgccaggagattttccgtattcttttctccaaacaggacttccctggccatgaggggattatctgtaatcacattatccgcccccaggatcttcatcctctccatctcactcttacggtttaccgtccatacatggactgctttaccgctttcgtgcgcctcatctatcagtttctggttcacagagctggagagcatgctgataaaatcgatcgactcatccttataatagctcccataggcagcggaaacgatatatcccgtataaatatcaggaaccgccttcttgacccgctttaaataactgtagctggtggacgtcacaacacattgctccgtccatcccattctctcaatgcattccgccaccttctcaggaaggctgctggatgcgcccatatactttatttcgatattcagcttcaggtgtccccgcgaaaattccagcgcctcttccagcgtcgggatcgtggttcccttaaactcaccggagaaccgtgtacccacgtcaatatcttttaattcgtcccacgtcatggatttgacgctcttctctattcccgccatacgtttcagcgtgctgtcgtgaaacaggaccatcaccccgtcctttgtctcctggatatcaatctccgcataatccgccagctcatcagccgcagcctgcagggccggtatcgtattctccggggctgtcctggaacttcccctgtgcgccgtaatctggacttcataaagcaaatcttcgttcaggaagctgccgtttctcgacacatcaaaggctgcggccatgctgaccgccgtcacaacagccagcaggcccagaacgtttcttctgttcatccacttgcttctgctgtggccgctgagatcaaaatcccaccgttttttattcttgtctttccggtcatactggaaatacagcactgtcagcgccccatagttcacaaccaccgacacgatgctgatgacaaatatcagggcatactcgattctgtccctggccgccaaaagaagggccagctccactctccggtccataaaccggactgcaaagaccgccacaattacgaccgcaaacaggtacaaaaggatacaaaccgcagtaaccgccatattgcaggcggccagaataaaagaagtctttacgtatctgcctctgagaaggtctttgctgcgctccagactgtcccggaatgttctctgctccaccatgcatccaaaacagataaaggccgtcggaaacgataacagaacacaggctgccagaaaaaccacaatcagaagcctgccccagttttcgcccaacagcccgggcagaataaatttcaaaggctttacatggcgtagtattctgtaaatcataaaaatattagtcaggatatagtgaaccgcaattaccagaaaaagcttccagtttttccgttttatctcataagctgtttttcccagtcctcccaggaacatggaaaacacatttatcttcctggagtacgccgccgactggaatgccgttgtcaggctaccgatttcgatcatcagaccagtcaggatcacagccgcaatcagcagcactacggcaagcgtaaccggttttaataaaaaagcgcccaggttattcaccgtcacatagctgtaccccgccgcgttcagcgccaggcggaccagcgcccctgtcatttgcagcagaaggggaagagtcaaaagacggaacgccagctcgaacagaaaaatatttccgttgttaacgcttaaaatctgcttcgtatcctcaaattcccgtcttattttcatcttccccgtacttctttcttctttttagcctgtcttaagacctttcatcattcttttaccgctgccgtctccgcagctttttcatcctcactgattttcataattgcctcgttgagtgagaacatcttggcatccagcatatcgaccatgtccgcacaggccttcagctcctcctccagataatccggcgcatgcccttcaaacttataatagatcttgtgttccaggctggcccagaaatccatggcaattgtccgaatctgaatttcaacctttgtctcaattggcccctcgctcaggtatatcggtatcgtcactaccagatgatagctcttataaccgttgggcttcgggtttttaatataatccttgatataaagcaccgttatatccgactgtctggctatcatatccgcaatcagataaatatcggatgtaaaagaacagataattcggatgccggcaatatcgcttaagtagtcaatcatgttggggattgtcacttcacgcccgtcattctttaacttctttacgatgctctccggcgtcttcagcctggatttaacatgttcaattggattataattataaatatggataaactcattattcaaaatctcgatctttgtattaatcgctttcagagcggaattatacaaaaacatgaccgttttccactggtcaagctgatcatatgttttgggaatattcaatggctccctctcctttaacttccttataggttgctcctggtaacagttcggcggccaggaacacgctccgccgcggtgaaatgagcgctctgcgcccgtttcaccgccaatcgatgcacagaaacggtaaggaagcagcaaaaacacctcgcggaatacatcatggctgaactggtactgaacagtacttcagactacagtttaaggtttttaaaaagctctcccagtcccgtggtagcctcaccggattcatggtagttgaacacttcctcctccggcgcctcattggcctccactgccttcatgctgaggctgatcttattatcggctgtcgaaataatcttaaccgttactttctgtccttctttcagcacggcactcggatgcggaatgcgcttactgctgatctgggaaatatgtacaagcccggacaggccgttctccagactgataaatgctccgtatggtttgatactgtcaactgtaccgtccataattacgccgacctcgcatttggcgattctgcgttttttctcttcctgaagcttttccctggccgcctctctaccggacagaaccagtttattatgctcttcatctgccgtgattacagtgacatcaatggttcttcccagaaaatcctccagattctccacataagcggcgtccagacgggaagcaggaataaagcccctcattccttcaatctgtgcaatcgctccgctgtttacaatctcagtaatttttaccggaacaacggtccgctcctcgagcatggtcctcagtctgtcccaggccatcttatcgttggcttctttcatggaaagcacgatatttccctctccgtcgtcggtcttaagtacggttgccgtgatctcatcgccaacgtggatctcctctttcatattaaaatcgggatcattgctcaggttctctttctcaataacgccctcggcataatacttcaaatcaagcagcacatgagattcaaataccccgattacggtgccggtcaatatatcgccctcacgtaccttcttaaaggatgcctccaattcagcagcataatcatccattgattccgtaggttccgctgtctgggccagctcaatcgcctcagcctcattctcccgtgtttccagaacttcttcagtccccattggtttcgattcttccatttccgccccatatgtcattttatctgtcataattttctcctccttgtattttgtttaataaatccttctctgtatatttaaccatatcccacctgatatttctatagttttctagtgaaaagtatgatatatttttaatagtttgataatttttgttcggaaatgaaggaggctaacatgaaagatatccttgacatacattctcacacgattgccagcggccatgcctacaatacactttatgaaatggcaagggctgcggcggataacggcatggaactgttcggctcctctgatcacggcccggcccttccgggaagcagccatgaaatgtacttttgtaattttaaatccattccaaaggagctgtttggaatgaggctgatcatgggatgtgaattgaatattctcgactataagggtacgctggatttgaaggaatggctgttaaaacgtgtagactacgggatcgccagcatccatgatctctgttataaaacaggctcgcgggaggaaaatacggctgccgccgtcaatgcgatgaaaagtccgtatgttcaggtgatcggccatcctgacaatgccaatattcctcttgattataccgcactggtgaagggagccagggaacaccacgtgctgttagaggtcaataatagctccctgaagccgggttccccccggccgggagctaaagaaaattattatgtaatgctcgatctctgccgtaaatataatgtgtccgtcattgtcagcagtgattcacactgcgcatcggatgccggatgccacagctatgcgctggagctattaaaagagaccggctttcccgaagagctggttgtcaattcctcattaaaaaaattggccgaatatcttccctgcctgtaacagttcatccctgcctgcagctttcccgggaattgttacaggctaataattgatcccgacaattcctatccgtttgtcctcaccaagcccaataattatattgggctttcctgatttatcaccaactgcgagaccggcttccgtcattttcagagagtccaaatccgctcctttaacagcatcaatcagttcgtcggtgaaaactgcgtcagggtttaaatccataaattcttcctcactgtccacagtcacgccgtctcccacccctacgtagcagggatagaccaccaatttcttcagcttttccaaatccctgtcttcaattatattctgtacatccttggccagagccttatactctgtttccagctgtttctctttatcatccgcagtaagagcggtatctttttccgtctcttctgccgtcgtctgagcagtctccgcctgtgttgtttcaaccgcctccgtcgtaccggttcctgatgtcctgccagaaccgctgcagccgccaagtcccattgccgctaccagcacaatcgccgcaatcaattttttcttcataatctgcctcctgcatgctcaaggtttctgccttgctcattttgcgataataacatggtttgaaacaactgtcaattcttttaccgaattcttaatataccttcccggcctgttcaggaccaggcggcaaaaaggcacctgccggacagaataccatcttatccgcacaggtgccgtattgccattatttttaagctttaaagcgggaatgaattttcagacacgctcaagtgtgttatgctgaagctgttctcttcgatctcatatactgccatgccgtcggtccgattaccagaatcaaacctacgatatcagtcatcatgcccggatccatcatacagaggccgcctgcaatcagaagaattttaaacagcagattcaattttccgaaaaggaagccgttcagcgccgccgcaataccgaatatgccaagcagagaggttatacaaatctggaccacctgaaatgcattcgtattgataaagaccattgccggattaaaggccagaatatagggtacgataaaggccgcaattgccagacgagtagcattaatggccgtcttcatcggcggggccttggctatggccgaaccggcataagcagccagcgcaaccggcggagtgatatctgccacgattccaaaatagaatacgaagaagtgtgcgcataccaggttgataccgatttccggtgcaatcaggataggcgcgcaggtcgccgccataatacagtaattggctgtcgtaggaacgcccattcccagtacgatacagcaaatcatcgtcaggaacagtgcaataatcggtttgccctgggatactgccacaatagccgtgatcagtttggaagccagaccggttgaagtaatgcacccggctaccaggccggccattgcacaggccacagccactgtgattgttccttttcctccggcctccagcgcatcaacaattttagttaaattaatacggttatccttattaatcaaaccaacgccaattgcaataaagatagctacggatgcagagaactgcattgtgtaggtattggtcgatacaagagccaccagcactataagcggagcaagaagatatattttcttaatcagaattctcattttaggcagctcttccttcgggattcctttgagtcccagcttttgagcttccaggtgtaccgcaatatagactccggcaaaataaaggactgccggcaggattgccttcacagctaccgtcgcgtaaggcacgcccatatactctgccatcaggaatgcggcagcgcccataataggaggcataatctggccgcccgtagaggaggccgcctcaacggcgcctgcaaactcgggcttatagccgcatctcttcatcatcggaattgtaacggaaccggttgttacggtgttgccaacggaagaaccggataccatgccgcagagcgccgaagagataacggcaaccttggcaggacctccggccgaggagccgcaaaggctgttggccagatcaataaagaaacccgatattccggtccgttccaaaaaagctccgaaaataataaacaccacaatatatttggcgcagacattgatcggagtattcattacgccgcttgtcgtataaaacaaatcataaatcaccttgccgaaacggacggtggaaaaggtgtacaccagcaaagcaccgacaacgcacaaaatgggaataccaacacagcggcggcacagttccatcagagccaccacggcaatgatcgcgatcaccaccatcatcggatctctggtaacgcgggttgccagcttgataatctgctgtgcatgcaaagcaaaatagaaaaacggagccgaacctgccaccataataactacatcataccatggcatatagttgacccgggtaaccccctttttgatcggataattcaggtagcccagaatcagaatcattccgaggaaagtggtcagacgaacctccggaagtgcagtgctgaacagtgttacataaatgcagtagatggagaaacccaccgacagccatcggatgattaataacggtattccttcccatatacggacattggattccctgtcgtattttttcatgaccgcttccacatcggcggccgtacctacatcagcatcctgtaccggaaccggttctttcatattctcgtcattcatattctcgttctcccctttcttttcatgcccagttatcataattcactggtttatcccctttataaaagctgcggcaggctcacgcccaccgcagctgccattcactctgaaaagatcaagatcactttgtgggaactgtaattcctttttcagcaaagtattttgctgcacccggatgataaggaacagccgtaacggatgatgcaaattcaagactcagttctgcgccctttgcatgtgctgccgtgatggcatccagattctcaaaaataccatacaggaagttatatacatcagcctctgatacatcgtcgcgtgcaataacaaccgcgcctactgcaactgtcgtaacatcgccatctgtgccataagccgatgccgggattacgttctcgctgtagtaaggagaagactcgatcagagcgttcatatgttcatcgtcaagacctaccagataaacgtcttttgttgctgccagagaggtgatggctgtggtcggtgcgcctgcaactacgaaagccgcatcaatcttgccgtcctgaagagcctctgcactgtcgccgaacgactggtatgtcggtttgatatccttctcaatatccagaccgtatgcgccgagtacgtcaactgcgttgtaatatacaccggaacctgccgcgccgacagaaacattctttcctgccagatctgcaacggatttgatgttcggatccagggtaacgatctgaatctgctccatatacagcgctgcaactgtcgagaaattctcaaccttgccgtactcttcaaacaggttggttccattataagcataagccataacgtcggactgtacgaatccaagctgtgcgtcacctgcatccatcgcctcgatattggcctgagagccgccggatgtaattgccgtaaccttagtactggtgctctcgcctatcttgccggaaagtacgccgccaaagccgtaatatgtaccctggtctccacctgtagtgaagttcaggctggtgccgccttccatgccgcccttaacggttccggccgcctcagattcggctgccccgccttcggtctctgcttccttaggagcttcggttgcttcaggagctgctgcctgtgtgctgccgcctccggaactgcatccggttaaaacggtccccataaccatagcagccgccagtacaagtgctaatttctttttcatagataattcctcccttaaatgaattattaaacatcccttcattttgactattttacgtcaatctgaacggatatctgctggtttcattatacaggtatttttatccaattacaatacaaaatattcttatttttaacttttcctttacattttaaaatattatagcaaataaactataaaaaccgttgttgtttttgggaaaacagaaagaactttaatgtgaagataaataaaaatatgtctggttttaataccgtatgacaaaaaaatgacagggactgccaaagcaccggctatccctgtcaaaatgtcagaattaaatttcaaattgatgatactacagcattatttcagtcctaaagcttccttaatcttagaaataatcagaataccgatgtctcttgatgcatctacggactgagcaccgatatgaggagatacgataaagttatcgcactcaaacagcgggctggcgaaagagtcatttccagtaaggccgctgcctgcaagctcattctccagaacgtctgttgcataaccgccgatcgttccggccttcagagcttcatacatatcctgctcattaacgataccgccgcggctcatgttgaggacaacagcgtcattcttcattccggcgatggattttgcattgaacagatcttttgtatctggtgtcagcggtacatggatagatacgaaatcagaaaccttcagcagttcttcgatggacatgcctgtagcattctctttctcaaagtcttccggtttcaggaatggatcgtaagctacaacggtcatgccgaatgcgcgtcccagctcgcccacacggcggccgatacgtccgaatcccattacgccaagagtttttccgcgaagttcacggcctacgaacttatatttatcccactcatgttttaccttaacatcatagtttgctgtaaaggttccgcgggagatatcaagcatcttagaaaaagtcagctctgcaactgcatttgcattcatgccgggtgcgttaaagatctgaattcctttctcttttgcatactcagtatcgatgtggtttaaaccaacggagcatacaccgataattttcagattcttggctgcatccagaacctctttatcgatcttcgggtctacacgcatgatcagcacgtctacatcgccgatctgggcaattaactgctctttggtggaaggcaggttgtcagccgtttttacattcatgtatttactaaattcttctgcaattcctgcgtacactttgtcaatgataagacaattcataataattactcctttcaagattcatactctgctattataccagttatttataggacaagcaatgaaaagtatgtctgctgctttccattattttaaacaaggggctgctgccttaagcctcatgccttgcgtcggcattatatacttaatgcagcagccccaatcattcagacaaccgcttatgcaattgttattaaataatagctgccggtcttcagattaccaagcaatgccctgagccatcatagcatcagcaatcttctggaatccaacgatgttagcgccggcaaccagattgtagcctaagccgtaacgctctgctgctgcagcggaaccgtcatggatatctgtcataacctgatgaagtttggagtcaacttcctctgctgtccaggaaagtctctcgctgttctggctcatctcaaagccggatacaagaacgccgcctgcgtttacagccttggaaggagctactaccatgtttggctgctgcattaagaatctgagagcttcattggtagttggcatgttagcaacttcgatgtagtatttgatgttgttagcaacgatcttcttagcctgctctaaatcaacatcgttctgagtagcacatggcatgatgatgtcaaccttctggccccatggtttctcacccgggaagaactgtacgccgaacttgtctgcataatcctgaactttgttacgtccggatgctctcatctcaagcatgtagttgatcttctcttctgttgtgatgccttccggatcgtagatgtatccgtctggtccggaaagtgtaactgctttagcgcctaattcagcaagcttcttagcagcgccccatgctacgttaccaaaacctgctaatgcaactgtcttgccaaccagggtatcgttctcatgtttcataactgcttctacatagtatacggagccgtatcctgtagcttccggacgaactaaggaaccaccgaaggatcttgccttacctgtcagaacgccgttgtagaatccgccgacaattttacggtactgtccgtacatataaccgatttcacgagcgcctacaccaaggtcacctgcaggaacgtcaatgtccggtccgatgtgacggtataattctgtcatgaaagcctggcagaatctcataacttctctgtcgctcttaccgttcggatcgaagtcggaaccacctttggcaccacccataggaagtgttgtaaggctgtctttgaatgcctgctcaaagcctaagaatttcatgatggaaaggtttacagacggagcaaaacgtaagccgcccttgtacggtccaatggcgccgttgaactgaacgcggtagcctgtgtttacatgaaccttgccgttgtcatcctcccacggaacacggaactcgataactctctccggaattaccattctctcgagaagagctacttcctcatactccggatgtgcatcaacaaccggacctaaagaagataaaacctcttctactgtttgtacgaactccggctcgtctgcgtatttcttctcgacttccgcaattactctgtcaacatacttgctcattgtaatatacctcctgtttgatatatgattttaaaagtttcactactcactggaaccatattatgtataacttcaacaaaattccctcacgattcctattgtttttgtgaaattttctgttctgtttttattataacgcatttcacttatataagcaaattgaattagcattataattgttattagattttgtttatattccccaaatgcggtgttttttaccaattccgcacctggagacgggctttacgccgtacagcggcgaaaagcctgcagagcagacctttcaccgcctggtaagtctatttgattagccaaggaaattgataaatgctgtcaggatggaagcgttgcagaaatcgatgaataagcttcctactaacggaactaccatgaatgcggtaggagccggtccgtactgtcctgtaacggcctgcatgttcgccatggcgttcggtgttgcacccattccgaaaccacagaagccggttgtcataactgctgcatcgtatgttcttccaagtacgttgaatacgacaaagtaagcgtatacaaacataagtattgtctgtgctgccagcattactaccagcggaagcgccagctctgcaagctgccagagtttcatatcgatcatggcaagtccaaggaaaatggacagacaggagccgccgagtgttccgatctcttccatcgggatttctttctgcatggcatccattacgttacggataacagcacctaccagcatagcgccgatgtagaatgggaatgtcatcagctttccaaggaacatggaaacaacggtgccggcaccgatagcaataatcagatacaggaaggcatccaggaactgtttagagtcaatagcacctgtttcgtctttttcaaccatctcttcaatagttgtatctaaagctgcggattttaaattaaatttatgaattttattgtatgcaataggtccgccgattgcacagccggcaacaagaccaaatgttgcggaagcaatggcaactacattggcattggcaacgcccagctcttccagcatcgggccgaaggaacctgctgttccgtggccgcctaccatcggaatggaacctgtggcaagaccaagtcttggatcaaggccgaatgcagatgcaaggcctgcgcccagacagttctgtaatattaccattaccacggcaaggagcaggaaaacgatggtctgaataccgccctttttcagcattttgaaggatgccgtgtaaccaacgctacagaagaatgccaccatgaatacatttttcagcgtcatgtctgcagagatttcaaaaattccagcgcttctaacaaccagatgcagaatcgcatagataaatccaccgactaccggcgccggaatacaatacttacgcagaatcgcaatcttgtcaacaaggatacgccccagtaaaagaacaatggccgcaaccgcggttgcctgatacatatcaagctcaataactttcatacaactacctccaatagattatttgtttacgttgaaggcagtataaatcacttctctcaaaaaactacaaaataattcaagaatatattcaaaaatttataacagttttttaactttgtttatagcatctttagaattacccgaaatattccgctgcatgtccggcctgaaatccggtgtctgtcagatttcccggtcggcggccagcatcaggctgtctataaatttcttgatgcttaccttcccgccgtacttcctcttaccgcggatataatccatctcagcccttatctcctcaaaggggaacagggtgcttgaataggatgtgaatgtgtcattcataaaatcctcaatccccagatgggcgaggttggacattcccacggcaatcgccctcctgattcgctgttccatgtttttaggggcgtcgcttaaaatctcgcaaagctggccgatgcttacctgggaaatcggccgcttattgctgtgcagatactggcagatacgcataatatcatcaccgcccttttccccggacatcccgagcctgttgagaatatactgtaccttccggccgtaaccgtcgtcgggtttcttttctttgggcatgtccgcaatctcagccatgaacatttttttaatgttggacaaggtcttctcgttctcaatctgcttttccaccttctggataacagacttcacttctattatattaatcggtttgctgataaagaactccattcccgcatcataggcttttccgaccagttctttggccgaaacctgggaaatcatgatgcatctggcgccgcatcccttttccttcagttccctgaccagttccacgccgtccttgcccggcatcaggaaatccacgagaatcacatccggctccagcgccagaatttcatccacattggcaggcccgccctctgtcgtaccgcagacggttcccagttcattgtcctcaataatatcttccagaatactgataacggttacgtcatcttcaacaatataaatttccatatcatgactcctctaacatctcagccggtatcatgatgcggaacttggttcctttaccggtctcggattccacatcaattttacctttaaattgctcttcaactgcatttttcacaccaacaagtccgactccacggtaaatgtttccggtcttttcgtcaaactttgtcgaataccccattttaaaaatattggaaagctgtctttctgaaattcccggcccgtcgtcggttatttcaaatatatagtcgttcccctctttgcgctccgcgatacataccgtaccgctcttctcctttgtttcaatggcttcaattgcattattaaccaggtttttgagtacagccatcaatatataatgctctttggttataaaattatcctggcagtcatacacgaggcgcacatccagccttttctctgccagcatgtgataggtggacgcctccagaatctgaagaagatcctgaaaattcatcttttcctcatcatactcctcatcgatttcctcctcaattccctgaataatcctgatgtaatccttctttatctcatggacatcccttgcaatttcgagggccatctgctgcatctccttcggaagctcctccatcatcagagtcttctcataaagccggtaagcattgctcataaccctctcaatttcctctgtgttcttatgcatcaggtaaatttcattcttaagccccgttgtcataagaaacagtctctggtaccggttctcatgctccgcattcttaaggagaacgcggtactgcttttctccaatcagcgcaacggccgcaaacagcgtacgcacagccgctatcatcagcagatatttgatgacggacagttccggcagcattctttgttgtaggtattcctgcagggagacttcaaagacatttgaacagaagtcacagaaaaagaccgctacaatcagacgttccatctgaacgatatgcttattcttgatctggagtttaaaaatgagtccgtagcagatatagaacagcgctcccgggagtacctgaatcaggcctgtttccagcggcattccctggaacagcagtataaccagacggaatatatagatagtgcaggccgttacaaaacaaatcgttcttgtatggacctggattcctaccgtcataatcaggacaggaagcagaataacggatgtagaaatacggaaattatttacaaatacattccagtagagctgagaggcaagggcaatgatcactcctattgcaagtgtccgcttccacagtttcatattcatctcaactgtattcattcgtaatgtcctcctaacggccataaagtgtcttatcctttgaactttttttatgataaaaagtgacaacacactatttttagtatacttcttttcgggcggtctgtaaatagggatttaactgaggttggggggacgcggccgctgcgtgtttccggcaggctgatatcaaatcttcctctattctttaataaaggtgcattgaaggcatatcgtatttttagtacacgggagcgccgagtggccgcgacaaggtccgccccgcacttaacgcgtgagacactcagcggccgcaggccagcggacggggccgatacccccggcggagtctttcgtcccggcgacaaccttccgggagaaggagatactgccgacatcttccggcggagaaggagagaatgatatccggctccgccctgcgaaagcaaaaaccgcagtatctccttctccagccagcaatgccacttccccgggacgaaagactcatagatccatcccaccaccccgtccgctgaccgtaccggcggcgtcctcacctgcttaattaactacacaagaaaccggaacggcgccatcacaatccccgttattttcatggccagcttcttccatcccgggatttcagccaccttaatatgagaaggcgtctcatactccgacgcattcactactctgcggcaatcctccctgatggcatcgaaatgacctttgagttctctggtcagcccctcgcttttgattaccagcatcagctccgtatcgagatatgtgcttctcaagtcaaaattataggaaccgactgccgcgatgtcgtctccgagtgtaaaggactttccatgggtcgaaatccctccgtcatattcgtaaagagggatttccagagccgtcaggtctttttttctgcgcaaatagtcgctggatgcaaagaaattgtctccgttttctaccgaattgaggactattttcatatccggtacggcttccttcacttcttttaggcgtttttccatatatgtattgcatacgagataaggggtatggatttctgtctcttttccggccgctttcataagctgtgtcagctgataaaatacctccggctcttttgcgtatatcccggtaggattagttaccaggcagatgccttccgtctcataggtctgcttttcataatccggtctggcaaacagctccggattgtcttttctgagggagttcatcctgtttctcagcatctcccgcttttcggcaacgcttttcctgtcctccagtttttcactgtcagcaaacggctttgtcacttcaaggttccagacgccctgaaaataattttcaacctgataaagggagctgctcagtccgtcgtttgtgccatgtgccgaattatatacaagaacctcccgatccagactcccgtgttccgtgtcataatcgcctataaagtaatcaaaggaattgcgcccgccgagaatataaccgatatcatctacaatcacatacttgtcgtgcatcctcccctgggttttccagggtttaagtaaattaatcgggttgtaatggcgtatctcgatattaggatgggacgacacggcataaaacaggctccttcccgtcattctgaccagcccggaaaaaccgtccaccattatctgcacctttactccctgatccgccttctccaggatcagggcaagaagatctttcgtgctttccccatccctcatatcaaaggtggacagaataatccgctcctccgcctggtttatcagacggagacgttcctcccaggcgcttagatttgtctcaagaatcattgcacggtcaacaaaagcatcctgctttccgtccaccattgatgcaagttccggcagcagaccggttccctcctttacttctttataattaaggaagggaaaaacggcccccacagccagatacagcagaatcaggacaggcaggagccagaggcgctttttgtttttatgtttcattccatttcctcttttttcagcgttttagtaatattggcggcaaacttttcaatccgcgcttcaatcccgggcagcttcatcgccgttcccgctttattggccgtctccatcatcgcaaaatttcccggaagataaaatgtcttgttcatgttgagagcggcaatcaattgttcggcaactatatcactgcctgaataaccggagactataatgccgaacagcgctttgtcataaaatctcgtagttctgaacaatgcggtcagccggttgataaatgccgtcatatttgccgagagggcatcgttataattgggacacagcatcacaacggcattggcccgtttcacagccggataaacatcttccgcaataaccccgccgtaaaagcagcttccctgctccccgaagtggagacacattctgtaggggcagccggagcagtcggacagagtgccgtttctaagcccaatttccgtaatatgaaaaccttccaatttttccctcaccgcattccatacggcaaatgtattggatgtctgatggctggatgcgtgcaggacgagcagatccggacattcatacacgggatttttaaaatccagaatctcccggaccagaagcccggcgctcttttggtaagcagtcattaaatccgtatccatattctgggctacgatggcaaaattcgccagggaacttgtaccttccaccagaggacggcccacaaaagtacagccggcgaagttagccgtaaaggtaagttccctggctgcagatttggtaaaaagttcactgtcggcatctacgataattccgcctgtccagccatccagcatacccggatgttccctgagaaattgaatcactctgtaatattccagattaattccggttttcccgagggaaacggcaaacagcagccgctttgaaccgcctgctgtgtcttttaaaaaatacgtcatttcctccgctctgtgaatctcatagacagaacgccctttaagcgctacatccagcacgccctccagacgccccgactgtgcgctctcaatgtccgtcagcttaaccacaatgatatccgaactgttcacaccaacgcttcctttcttacggcacgactcgctttctatgcggagtccgcgacgcttagtctgccaaaagcgccgggttctctctgaacatcaggttatacaattttctttaaattatcctctgctgcggcaattctacggtagagctgttccggcagaggcagaacctctgtctcaaggccgaatgcggtataccggttctttacacccatatagatccctccaaggaagacggagccgcagtgccattctccgcgcatcatcagaaccagggaaatggctcccgaggaataagcaggggcgataaacggtttgaagccgatagccctcatatgaagatttgccgtcacggttaattccgtaagctctttcgacagttcatcattataatccgtgatggaatccgctaccaccagatcctgaccgtgtgggccaaaggagcggccttctgtcagaaaccgtttaaagcgttcgtcacgttttgcaaaatatgcggcccgggcattcatgacgcccagcccgaatccatgaacctgctcagggcggagtccctgataatccagaacaccgctgtcatccttattgctctccagccaggccgtttttgccagcggatcgaccggatcagacacgacggcaaaaagacctttaaaattttcttttcttgcctgtctggcatactgggccacgattttggaattgttttcaaactggtacattctcacgtccttgactcctgaaccaaccggcggaatccctttggaggccacaaaaacaaaaacgtcgcatttgaagagatcctccgcactcacgatatctatttccggaagggcgtcgtaatcccacgggtatgcaatctggttctcctcaaattcccatctggccgtcactttatcggaaatatcacagattccgatggagcttatcacatcgccgcccagcaggtgaaggccggtgagaagcgtactccccacatccccgattgccagcacattcacgcgctttttgccgccctcctgtctttccctgagtatctcgataaatttaggatgacgcaggttcacggcgcgcatttttcctgccctgattacgctttccgtccactcgtcagccttttttcccccggccgcctcttccagcttcacgctgcaaagccatgaagaatcctctttttcagcaaacagcatggaggaatcattgaccttaaacgatgcgcggcagcttcccggctccctgtcaaaaagatatacaagagaggtcacctccttcggggcttctgttttttcatacggcaggctgccgtccagtgaacagcagagctgtccctctattttgtaatagtacatttttctcctccttctttaaaatgcttctctacctgtcatgctcatgccccgccgccttttttgtccggtagagcatctggagatcattttccagatacaccgacgcagccaggttcggatcatagcttacgcagtcccctttatccgggcagaggggaagaatgaccgcctctgataaccggctgagagtcaggtttcttgcaaacagatcgcggtattcggcctcgaggaccagcataatatccctggcatttctgatacagcaggccgaaaattcaaacagtgaatcgctgctgcagtctttcagcggcggcaccgcatagggcagtatcatattaatggatggagtcaggccggccacctgtaccgtatcacggcggaccgtatctcccccgacaaagggataaagcgtggactccacgaaccagaatttaaggttcggcacaaagtaaacgctgtctgcctccactccctttgtcgccatcgtatcgcgtccatacccggaaatcagtccaagaagcactttcttgatctccacccctgcttccttgaacatcggttccagagcctcaaaacggcctccccggtgcagtaaatcatccaccaggattacaggccggtcaaaggatttgattccttttatctggctgctcagaggggaatagtaagggaatgcttcaatggcatcttccttcagttccgggtcaaataccttatcggtatggagtgtttttgtcaccgtattaggtattacctttcctctcagaatctttccgaagggaacacacatatactcacccagtattctcggctccaccggttctctcggcaccccgttcagagtagttattttatctacaagccggtgatatatcaggcttgcggaaagtgacagaaccaattgccccggatacagacccgtcatcgttctctgcaaatcatgatgcgctttgtaaatggcttttaataccctgggattgctggaaaacggttccttcagcgttgtctccagattctgcatcagcagaagcggcgcatgcatatccaccaggaacaaaggcgcatcctcctggaattccggcgccttaacgaagccctgccgttcaatggctgagcttacgcgcttcgggcagactccctcatatgggaaaaatatggcatagccgcatttccaggcgaaggagcgggcgatcacctccgccagaagaagctgctccgcatcataaatcgccggttccttttccacatggattcccgatatcagaagaatttcccctgaagtgtggcggcggaccagatctgccaaatctaccttttttaatactgcaaacagctcatccggagccagatagcggaacctggcaactcccaccaggcggttgtcctccaccgtatttctcagcagaagcaggttgtcacccgcagcgcggattgattccattatctgggccctgtgctcctcatcccgcagtaccgactctgaaatctcggacagaagcgcctcatccggctcccccggttcctcaaatacaattgccctggcccggataattggcttgtattccggttctctcagatacaggccgttgtaataaatatattcctggacagacggatcaatcaggttggaaatgtcgcggttcatatcgatattttccctgatttttgtggagctgatgtcctccagatgttccggaagctccagttcatatacttttcccgtaatggactccatcatttttctgttaaaccggttatccgacctgacatctccgacacggcggaaagctatatggttcatcgaatggatggaattatcacatggttcctttttataggaagaagcgttggctatcacgtcgcttccggccacaatatatacttccctgccggcaaatacttccttcagccgctttaaatccgccggatttgcaatattaacgggaatgtcatccgggaacaggtttacatgaaattcatcggccaccgacatattgacaatctggcgccggatcagatggggctgcgccttcttggaccatgaaaactcgtccaccgccagataaacctcatatcccatattccgaatttcgcgtacgatttccttatgcgacagagtaaacggatcaaacgtccccgggaagaatgccaccgcattccgttcgcctattgtaaaatccccttccgtcaaacggtattccgtgatgaaacggcagatattggacagagcggccgcacggtagaaagcggtcagctcatcccctttattttcatttaataaaaacagcagttttctgaagcagagtgagaatatttcattcttttcactgcaggtcagccgctttgaaccaaacactgtctggccgattacaagaagagcctcctggcttacagtctccctgtaattggcgagaccgttcagaagcattcccaggaatctgcgtctccggcactcccagccgtccttctcatccatgaaccgctcccggtaacagggatagcactccaaaagtatgcccaccgtatcgagcgccaccgatacgattctgtcattcgggctggccatcaggctgcttaaataaacaagtatttcgtccagctgttcggtcggcagccacagtgccacttctcccagatagcggggaatatatttggaaaattcatattctccaacttccaggcccttcaccagctcgaccgagatctcatttctctgatccggggtcagcagctcaataatccgaagcagggcatggccggcgtcatggcggacaaccacatgctcactcactttgatcagatttgaaaaatgggcggcaatgtgcagtatatgctcatattttccatgatcaatctgatccaccagaagttttatgttgaccgccttgataatccagggcgtggatgtcttcaggttatcgaggaaaatgtcggaaaccacatcgcggtcgtaaagcgctttctgctgaagctccgtatcgtatccaagattatttaacacacggtactgaaggaaggtcatcgtaatatcgccttccaccgttgtctccatcacgcattcagcgatgtccttacagcagggatgggacggctgatatgccgtgatgagtttgaatgcgcgccatgcggcaattctcacttccgcctctttggaatccgcctcataaatggcgaatcttccgaccctgcccagttcctcttcactgaaaagttcaaacggcatgaaatgcacggtatccaacagtacgaatgcctcccccggctccagctcttccccccgttcataccattttaaaaatgcatggaggaaatgatggaaatccgcggctcccgcatactccaccacagaatccagaaccaccttcaggttgtaacggatacggcgtttctgctggactgtgagcttgtgatccggacggataatcatctcaagatattcattccaaagctccatcacccgtgcctcggcgatgtccggcatatcggccggacgctctttccggtaccccgcgttaaaccgggcaatcacgtggcccaggagcttgcccgcctgcgccctgatatcaccttccctgtgcatgagaagctcatagagaaacccaagcgtctgttctttctgcttatcgtttgtataggtgaaatattcttcaaaaatattcaggtaggcgcggacattcttccagctcttctcgcttctggccgcctccagaagatttccaaactggcgttccgccgccatgcggtgcatgatttcaatattatgttctattcccataaaaacgagagactctatggtctgctccgtatttctgagcgaaatgtcgggaaggggcgcccgttttaccggatggccgtccagccccacatccactcccagggaacgcatgtaatcctcgaagtcatgcagcttggaatatacgaagcggtagcggttcagctttgtctcgtccacattgtccagtttggacaagatgacattaaacgcctcatcgagactggaaatataagtaatctccctgccatcctctccccggctctgtttaacccggaaatccgagtaaatcaataccagcgattccaccgacaggttctccggttccaaatcccaggtagaatgattggccgctatatggcctgtatattccatggagtgattgttaaaccactggtttgtatagtaatagtggagatagggaacgcgctcattcggcttgcagccgaatttacccagatcatggccggcggcggccccggatgtcagcgccagatcgatgggaactccggcctcccacaggccgcgtcccacggtcatagccacataatggactccggcgatatgttccagcgtcctaaagggagtgacatcggcattcagacgcatcatctcatagatatattctttaatgaaagtttcttttaaccgtttgtattcctcataggtctcaaatttaccggcctcctcatcaatcagaaagccgaaatcgtaaagcggatcatagggcagtatctcgcgctccatattgaaaaaatactggagaatttcgagatagaacaaagctcctgctgaaaatctgtccgtttctttagaaaattctgcgtcaggatacagaatatggcaggcatactggtatgtgaatttcatccagccctcttccggctccctgccgagcagggccagcggttcttcacagatttcaaagacaaggcggcaggatacccgctttttaataggaataagacggattaactgctcttcccagtgttctttattcattaacatcaaaatgtttttcttgcttaagccggatttctcaagaaaatctttgcggcacagcttttcggtgagatcggtgataatctggcggatttgttttttactcattccggttcctccttgattggaatttgggatggcatatatcagcagctcagttccgctatggggcactgttttttgcttattgtacattataccacctcgtctttcttcaatccagcggaattggagatttagttaagcaggtgaggacgcagccggtacggccagcggacggggtggtggggtgtgtatatgagtctttcgtcccggggaagattgttgtgagttgggactacgggcgaagataaagtctgcggagcacgctcccgctctgtgaaatgcatcgcgctgctaagctcgtaagggacctcgctaatcagcgatggatttcaacggcatccgcagactttatcttcccctccgccccaaggccaggttttcgccgggacgaaagactccgccaagtgtatcggccccgtccactggcctgcggccgctgaatgtctcatgcgttaagtggggagggcggaccttgtcgcggccactcagtgctaccgtgtgcgggaaatatgatatgccttcaatgcgccttttataaaaattgcggaagaattgatatcagcttgccagaaacacgtagtggccgcgacagggtcctccccatttaaggttggagacaatcagcgcccggaacggaccatgtccggtgtcgaaaaccttcgcctgagtgttccgtccccggcgaaaaactgacccggggaagtaggcggaatcaattgcggaggggacatgggagtccgccggtgcttagcgaggtccctcacgagcttagcactgctgcgcactccaaagagtgcaaacggtccccgcagcaattcattccggccggattccccctccacgaccaacctcccacggggacggaagactcagacagcccccctcaccacaccggacatggtccgttccggacgcgtcctccaaacctcagttaaatctccatttcttattcattctctgccatttttctgatataattaaaaatatttatttttttactatagttatctgaactaacaaggaggttattatgcaatatgagattaaaggcggcaatcttccggttgtgatctgctctcttgataatggggagtcggtatttaatgaaagcggggccatgtgctggatgagccctaatatggagatgaccacttccggcggaggcatcggaaaaatgttcggtcgtatgttttcaggagaaaatctgttccagaatatctatactgcccgcaatgacagcggaatgattgcctttgcctcctcatttccgggttctatcaggccggttgagatacgcccgggagacggtctggttgtccagaagtccggttttctggccgctgaagccggtgtggagctttccgcctttttccagaaaaaggctggagccggtttcttcggcggtgaggggtttattatgcagaagctgtccggccacggtacggctttccttgaaattgacggcgcagcggttgaatatgacctggctcccggacagaagatgattgttgataccgggtacctggcagctatgagtgagacctgctccattgatatccaggccgtaaaaggcgcaaaaaatatgttgttcggcggtgaaggcttctttaatacaattatcaccggaccaggacatatcattcttcagaccatgccggtatctaaaactgccatgtgcatgtaccagtatatgccgcatcccagcaactgatacctgcctgtccgtccagctgtgtgtgaaaaaggacacctttacgtgtccttttttcaattggaaatgaatactgcaaaaaacatttgacaaacatggctttatccgtcataatataaacagtaactattattaatatcatataaagagaggctgcttatgaaaacacttaagtacagccgccaaagggaatccattaaaacctgcctgatggggcgtaaggatcatcctactgctgacgccttatacaccagcatccgggaacagtttcccaatatcagtctcggtaccgtgtaccggaatctgaaccttctggtggatttaggcgagatacgtaagctttcctgcggggatggaaccgatcactttgactatgacacttccccccattaccattttgtatgtaaagaatgcggaaagatcatggatatctctatgaatgcggcaaaggggctggaggaagaagcaggcaggcatgtcaatggaacgattgaggatcatacgattttcttctatggcacctgcggtgactgctcttctgctgccggccggtaattttaaaatttttttaaatctgtattgacagatgaaacaagttgtgatatcttaatatcagtaatcgttatcgttattgatttcgattactgagatacacaacactaattaaactaatatttatatatgtaaagaaaaggagagaatagcaatgaaaaaatttgtatgtatggtatgtggttatgttcatgagggtgaagctgctccggagaaatgtccggtatgtaacgctccggctgataagttcaaagagcaggatgccgagatggcatgggctgctgagcatgttgtaggcgtagcacagggcgccagcgaagatatcatgatggacttaagagctaactacgaaggcgaatgtaaagaagttggtatgtaccttgccatggcaagagttgcacatagagaaggctatcctgagattggtttatattgggagaaagctgcttacgaagaggctgagcacgcttctaaatttgcagaattacttggcgaagtagtaactgacagcacaaagaagaaccttgagatgcgtgtagaagctgaaaacggcgctacggcaggtaaatttgacctggctaaacgtgctaaagctgctaaccttgacgctatccatgacacagttcatgaaatggccagagatgaagctcgtcacggaaaagcattccagggcttattagaaagatactttggtaagtaatacgaaatcaccacagcgtatttactatacaactactaacaatatataagtgaaatactcctccaccatttaaaatcaacaaaaaacacctgggtgagccggaaaaacggcctcacccaggtattttttatgtaacggaaaaattcagctactgcggcggcttctgcacacttcgaactgccgcgtcaactacatgctccatcagaatacaggatgtgacggccccgactccgccaggaaccggtgtgacagcctgcactacaggctccaccgcagaaaaatccgcatcaccgcatatctttccgtccgctccggtgtttacgccgacatcgatgacaatctggcccggccgtacatgttccgcacctatcaggccggcacagccggcggctgaaacgattatttctgcttccctgcagagacgcctcacttctgcaggcgccgtaaaaatatggcatactgaaaccgtagcctcctcattcagcaaaagcagggcaatagacaggccgacattgatcccctttccaataaccgtcaccctcttccctttcaggggaatccggtagtatcgcagcagttccaggcaggcggccgccgtacatggggcaaaatcattgcctgtccttgtcaccatctgtcccatggctgctgcggttatcacatccgcgtccttttccggccttaaaattcctgatagctgcatctcatccaggtgtggcggaagcgggcggaatatcaggcagccgtggatacccggatccgcattaatcgcttccagcgtccgcctaagctcttcaatggataccgtctcatcaaagaggaaccgctttacatccactcccagggcccgggcctgcttcactgctccccgttcataggcaatgtcgttccccctgctgccgacccgtactattcccaaagtgggaatgactccctttctctgcaatgcttcgcacttttccctgattctcctgcggacgttttccgcaaccggctctcctctcaacagagacgccatatgtatcactccttttcccaatccgattagacgaaggctgaactgtaatgattagattccctgttcctttaatatttccttcagcttctcttcctctcctgccttcatcttatagcagtgttccggcgccggataggttccgtcgtggcattcgctgacaaactgccccaccgcattaagtatcactccgcggacatctgcatatttctttgcaaattttgcatttttctcatagaatccaagcaagtcgtagaaattaatcatcgggctgtcactgtaaggcccgcagccggttcccagaatcggaatgctgctcctctcatagataattttggctacctctgccggtacggcctccaccactacggctatggctcccgccttttcaaatgcttccacctctttaatcaattccacggccgccagcacatcacgcccctgtgtcttgtatccccccctgctgaagcgctttctgcggggtcaggcccgtatgtgcgatgaccggaataccggccttcgtcaaagcttcgaccgtatggacaatctccatgccgccttcaacctttacacagtccatacctgcttcacggatataacgtcctgcattgcggatcgcctcttcatcgctgatctgataggaaagaaacggcatatctcccataataaacgcactcggcgtgcctgcacggactgctttcgcgtgttctatcataatatctaaatctgcctcatttgtcgtcttatggcccagcataaccgtggcaatggaatcccccatatttataatttcaattccggcttcctccgccagaaccgccatcggataatcatacagagccgtacgggccagtttttcaccgtttgcttttttctccaaaatatagctcagcgtcaccttttttcttgcttccattttaaactcctccttatgtattcaatttccctcttgactcgcaggcctgtgcgaagctgccggtatccggaatcagccgcctcagttcagcccgaaaaattctgcaaccttgccgacaatatgctctccgataccgtcatatgcctcatgggtactgccgccgatatggggacttgctgtgaatcctcttactccgaacagctccgactctagccttgcattgtccccaagccccttgccggccagctcatttaccaggacatccgtgctgaatccggccagttttccgcttagaagcgccgctttcgccgccgcctcgtccactactccgcccctggcacaattgattagaattgctccgtccttcatctgagcaaactctttttctgaaatcattcctctggtttctccggtcagcggcgtatgaaggctgatataatcggaaatggcgcacaattcttcaagcgtttccgctttgtcagctcccttttccttcattgccgccgcatccacataagggtcgtatgccgccactttcatattaaaggcccgcgccagttcagctacccggctgcctatcttgcccagccctattatgccgaggacatggccgcccagctcatggccggtatacttatatttattccagataccttcctgctgcacctcctgattcgcttccatcgtaaagcgggacaaatctatcatctttgagattaccagctccgcaaccgcgttacagttgattcccggagcgttttgaaccctgattccaagttccctggcatattccaggtcaatgtggttcgttcccgctgcgcacacggcaatcatttttacacgtttcgccgccgcatccaggatatccctgccgattttcggatcgacccgcattaccagcagatcatactccggcagcatctctttaagctcatccaccgacgggagtatcttaatatccacctccgcccccagcgcctgaaggccttttgcaataacaggagaaacacgatcaataattaatgctttcatatacaacaacccctttctgttttccttttgcccttattatagattggcagtgtcatgaatacaaatatataataatcattttatttatgactaaaagttatgattgtgagttgaaaatcccttctcttgttccaatatgatattagaaattgttacgctggatatattgaatgattcaaagtcagaaagtcatggctagccaaaatctttactccgtaatcaacatacaaatgatgcattaattcaaacgtttcgtaaaatgcttcaatatctgcacataatccactcatagcatattctttaaattccaatcctgctatacaatcataaagcggtactgcatcagagggaagcaaatattttccattacccgtatctaccagcactccctgaagtccttgggagtgcccgggtaataaaaggagttgtattccatcgcagagttcataattgccatctattaccttccatttgttggcctgacgtgcccatggaggaatcactccagtataaaaagtttcatacgtagttttaaatttaggtaaagggcagaccgcactcatcatctcttttttctgaatgtaaaaatcagcctgcggaaacagatgattattgtagcagtgatcccaatgaaggtggctcataatcaccgtatctatttctttcggacaaatacctaataatctgagagcttcatctggggcttcttcaggcagtctggttattccagggccatgattactaatttgcatagcttctgacgccggatctccaccgcccgtatccacgagaatttttcttccgtttccttcaattaaaaaaataattacgggaaactcttctctctctttatatagttcctgattagaagtaaatgctccgcggtaatatgaaatactccctacctttatcggacgaatcgtataatttgccattcttttctcctttcttacaggaacatcgttgataataccggcaaataagtaataagcagcacacacactataccagcaacaattaacggcattgcagctttaaataccgacgcaacctttagttttcccatacctgccgtcagaaatatgtttgcaccaaagggtggcgtatacatacccattgcaagatttgtacatgtaattacaccaaaatgtataggatctactccaaatgcctgggacacaggaaagactaagggagtcaccaacaatacaattgtactggtttccatcagcataccgcaaattaaatacaatacatttacaatcagaagaaacattatcttactattgcatatggacatcatggcattgctgaccattgcaggaattctggcagtcgtcatgacccatccaaagaaacttgcgcttccaataagaaacataatgacggcactggtgacagccgcattgctcatagccttaataaaacgtttccaggtaagttctctgtaaacaaagattccaacaattagagcataaacagatgcaaccactgctgattctgtaggcgtaaaaatccctccataaatacctcccagaatgattacaggggtaagcaatgccggaatcgcttcaattacgaccttgcgtttgttaacactaagaatttctcgcctgggtgcatagcccttttttacgataatcaataaggaacagagacagtaaaccaatgtcactaatatacctggaacaataatagcaaggaaaagcccacctactgaagtatctgtaagcgtaccatacaaaatcagtgtaatagacggaggaatcatcagccctaaagtcccccctacaccaatcattgcagcagcataattcggatcatactccccgtctttcgtcatctcagggtataaaatccccccaatcgctgccgatgtagctaaagctgaacctgaaattgcaccaaaaaatgcacagcagatgaaattaataaatgaaaggctccccctgattctacctaaaaacagctggacaaagttaacaatccgttgagatattcctccttgcatcattaattcacctgctattacaaaaaatataattgccattaatgagaaagaattaatggcgttaaaaaagcgctgcggaaacacaagcaatggtgttcccccttttgccagcaaagcaaaaatccctgaagcactgagtgcataagcaattggcattccaattagtagaaatccaatagcagtagtcaccaatactaaaattacacttaccaaaatttccgcctccctccatgcgatgagtaaagtgtcttcatccttccggcatttgtatcttctctgtttttatgaaaaaatccatataaatttcttcaagtgtataaatcattcccagaattcctcctaccggaaaagccgcataaataatagacatttgtatgggaagggctggtgaattctgtactgaaccacgtaacataaattggtacccataataaataagtaaaataaatacaaaactctgtaccattatggctacaatccgcatcactatttttacaaaaggcgcttttttaccagcaaattccagaaagctatctatacatgcaaaactcttcctacgtatggctgcactaacccccagcatagtagcccacacatataaataccgcatcaattcctcagaccaagatagggattgttgcaatacatatctccaaactacctgcattgagcccacgaccagcataatacttagtattactatcagtactgcaataattattttatctaaaaaatctaaaaatcgacacatcagcccgactcctctccttctgcctatttaatctgccagtaaagcctggatttccgcaatttgtgttccatactcatctgagtactgttcgtatactttttggcaagcctctttgaaagaagttttatcgacttctgttaccttcattccattgtccgataatgtctgtaatttatccctgttaaatgcaaatgcctgttcacgttcataaatacaagcttcttgcgctgccctctgaacagcctcctgctgctgattagtcagactttggaacaaatcagcattaatgagcaattctgccggggaataaaaatgttctgtgagagataaatacttgtttacctcaaaaatctttccgtccagaattgccatagcaggattttcctggccatctattgttccctgttgaattgcagtatacacttccccccagttcatcggtgtcggattcgctcccattgctttaaaagccgctatatgtacttccgactccattgttcgtatctttaatcctgcgagatcttctactgtcagtatttctcttttgctgttagtaacattacggaagccattttcgaaataagctaggcctttaattccaatatttcctaattcatccattaaattttgaccaaactcaccatctaataccttatgtgcatcttccacattttcaaataaatacgggaattcaaaaacattaaaatttgaattaaaatttgtcagaggtgcatttgttgtaatacaggcgtctacacttcccatactaaccccctctaccatatctctctctgctcctaaagttgcatttgggaaaatttccaccttaatctgcccatccgtatattgatctactaattctgcaaactttacagcccccaaatgataggggtgtgcctccgtctgaccatgcccaagctggattgtttttaccgaagcttctgtgttttcttttactgaatccggtcctttttccgctgatttaacatctccggtactattgccgcacgctgccaaattaaatgataatactaaaactaaaactgttgccaatactcttctcattttttcctccttttctcgactgaactttgcaatttcaacaaaaaaaccccttttttttcttatactttaataatatcttacaatcatttataagtacacgatctgttgttcatttaaactataacttttcgtcataattatactaactttgaggactgcaaagttctttaactgataaacaaattatatattaaaaaggttctatactgaatgttggggtgtgctgaaaagcacacttccaacattcttttcgttgtaataaaatacatctataagaagcctcctaaacgcattatcccgaccaaagtttaatgttatggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgctccttcgcaaacgccgttacctctgcccatactgccgcaaacggttcacggaaccctattcgttcctccccagctaccaccgcaggacccgcaggctggcattttacattgtctccctgctccggcagaccttttccttaaaacagatcgcagagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccaaagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcgattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggagctgcgtctggcacaccgcatgaaagagtggttctatgatatctgccagatggaagcgtatcgtcagcagcagagggaatttgatgactggattgcgaatgcgcagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagccattaaaaaaaggattaatgaccagctatctgaccaaaaatccttttccaactattaccattatgttatttcacacttatttatacctaatctcttatcttcaaaataccggactacaaaccgttcaaaaagcttgacaatatatgtcttatatgtattcccgttctgcatcagggtcccctcccagggaaacgtctccttgagatagatgattttcactttggggctgagatggctctgcacggcgtaggggcgcggaagaatacagatccctctgtcgcattccgtcatttgcagcataaagttaaccttggagctggatatattgaccttcgggagaaatccggcctttacgcagcgttccgtgatttgatgggacagcgcggaagtataagtgtaaaggttaaacttctgattttccaactgctcgaatgtcaccgaatcataccgggacagcggattatccacagaagctatcaccaccatctcatccttgaacagaaccgtgtcctgcaggtccggaaaagaagcgccggtaattccgagtgccagatccaggctcccgtccagcagcatcttcctcagcgcccggctcccgtcctcgataagctgcaattcaatatccggccactgccggttaaaatttgtgacaatatcgaccacataaagagaagctatcatcggggtaacccccagctttaatctgccaaccggggccgaatgcatcgtctccacaaatgccgacagcgaatcaaattcagagataatcggaacaacacgccggtaaaactgttcgccatagtcggtcagatagactccatttttctgaaccctgaagagggggacttttaactcccgctccagcttcttaatcagcttgcttaaggccggctgggagagaaataaatgctccgccgcccgcgtatagctctgatcctttgcgacttgtacaaaatattttaagaccttgatgtccacccaaatcctcctctgctaaaccgtgtgaacagtaactttcccggtccttatccctgtctccttcagttaacgagattcaccggacttccggccgcaaacgccgccagattatcggcccctatctctaaaagtctcgcacggctctcctttgctgcccaggctatatgaggagtaataatacagttcggcgccgaaagaaggggattatccatggatatcggttcctgagatactacatccagaccggcggcatatacctttccgctgttcagggcctcggccagatcttcatccacaacgagcgctcccctggagctgttcagaagaatcacgccatccttcattttcgcaatcgtatctctgtttatcaggccctgcgtatccggaaacagcgggcagtggagggctatgacatcagacttctcaaacagttccccgcgttcggcaaacctgcagttctctgtctcaagctccgctcttctgaaaccgtcgttatatagtatcttcatccccaatgcggcggcgatggcggccgttctctggccaatccttccaaatccgatgacacccatcgtttttcccgcaagttcaatcagaggataatcccaaaaacagaaatccggctgctgtccccatcttcccgccttcacagcatcactgtgatggccggcgcggctgcagatttccaacagaagggcaattgtaaactgggacacggaatcggtcccgtacgttggtatattgcagacagggatattccgttccctggctgcctggatatcgactccatcatatccggttgacaatactccgatatagcggatagacgggcagttttcaatcacctctctgccgagaggcacactggacaccagtactgcatctgcatcccctatccgttccataatcagtttcgtatcattcgccggtgtcctgtcataaatcgtcaaagcaccaagctcttcatagcggctccagctcaaatcccccggattctttatgtaaccatccaatattacaattttcatagttctgtccctttccgcttcttacagctccagatgtttgaagagaagactcagcgaccagtccaggtgctcgctgagtgcagcctttaatttctcaagatttctctccttcaggcagtccaataggaccagatgctgccttgtgctctcttccagatcgagggacacgtggaaagagataatcctgtaacgatcgacattgaaataaatctgatccatcagtatttttatgtatccgttattggatttctgtacaatcagatcatgacactgtccatccagcttgctgaactccatcctgtctatctcttccccagcctcatgccgggcaagcagcgacatcaggctggctctcaccgcttctatctcttcatccgttatctgataaattgaagtttcacaggctattaattccatagccttcctgacttcataaatgttcctgacgtcctttgtcgtcaatggtttcaaaaaggttcccagaccctttctggattccagaaatccttcagcctgaagacggcgtatcgcttctctgacaggtgtccggctcatattgagatacgctgccagctgattctcgcttaaaagctctccgggactgatctcttcttctatgatcagatttctgattccgtcatacgccctctgcacataactcggcttctgtgttttttttaataaaatgttctgttcgcccatttataaaattccttgtctacataatatttgaaaccattttactattaataaaggcgcctgtccagtatggcaggcgcctttttcccagtattttacagcttttttactatttgaggaagattgtggtacagatcggtacgtaagtaatcaaaagcagtaccgcaatcaatgccagcagcggctttataatcttcttagtcaaatcctcaatagaaactttggatatcgaagatgcgacgaacagattaattccatacggaggactgcagaatccaatcgcaaggttcatcgtcagcataataccaaaggtaaccgggtgcatccccactcccgtacagatagggagtaatatcggagtgagaataattgttgcaggaatattgtcaataaacatcccgacaatcagcaggaagatattgataatcaaaagaatcagaatcgcattgtccgtcagtcccagaatcgcctgcgcaatcatattcggtatctgcgccattgtcaggaatgccgcaaatacagtggagaaaccgaccataaatgtcgtggcgccattaaccactatggcgtctttgaatgatttgtacgcccctctgacatccagttctttatatacaaatacaccgactatgaaggaatacacaacggagataaccgcagcctccgtaggcgtaaagaaaccggaatagattcctccaagaatgatgaccggtgaaaggattgcccagaaagcatccttaaaggcaacccatacctctttcgcgctggacgccttttcttttcccctgtacccgttcttcttcgatacaaagtaacagacaatcatgagggccgcacccatcatgatgccgggcataaagcccgctgtaaacatatcggtaatcgaggtgcccgatacaacgccgtaaataacgaacgggatagacggcggaatgataacgccgatggtccccgccgccgcagtcagcgctgcactgaagggcttattatagccgtgatccaccatctcgggaatcataaatgctcctacggcggataccgttgcaactgccgagccggatattgccgcaaagaacatacatacgataatcgtaaccatgccaaggccgcctgttacatggccgattaacgcgtcaaagaaatttacaagccgcctggcaatgccgccgctgctcatcagatttcctgccagcataaagaacggaatcgccagaagcgggaatgaatcaacccctgtgattgacttctgcgcaataataatcagaggaatatctgaaaaataatagattgcaatcaggctggaaataccaatggcatatccaatcggcactgtcaggagcagtagtacgaaaaagcttccaaataatacggctgcactcatgcggcatttcccccttcctcaccttttataaacaatttctttacgtcttttcccaatacccccagcattctgacacacacaagaaatgaggccagagggaacacggaatacacgtatacaagcggtaacctgagtcccgaggaaacggctcttcttgccgccatcgacaccagcaggtcttttccgtttaccaccatataggcgcaaaacagaaaccatatcagatcagccagaagtccaatcgccgcctgcaccttcttatttttaaggaaagaataaatcagggtaactctgatatgctcattatatttcagtgcaatacttgctcccagccaaatctgccagatgaagatataccgtgacagttcttccgaccaggtaagtgagtttttaaatacagtccgcattataacctgcaaaaataccaggagcacgttgataacaaggctgacaaccagaaggtattcttcaagattgttataaatattgccaatccgtgacagtatacttttcttttccatactaaagctcctttaacattcgtacttactgctcgtatttctcagccattgtgaatacgtcttccccaaactcgcctttgtatttctcatacattggtgcaagagcctctttgaacgctgctttatcttcttcggtcagtctgttaacctgcattccttcctcttccagtttgtcaacatacaggtttgtgtcatccagttccatctggcgctgctgcttcacgaattctgccgctgcatccgtgacgatctgctgctgttcctgtgtcaggccgtcgtagaagtccttgttcatgataaagccaaggaagttgttaacatgctctgtaacgctcagatatttctgtacttcctggaacttgcttgcgtaaatcagggacggaggattctcctgtccgtctacggtattctgctgaaggcccgtgaacagctcgttgaatcccatcggagtcgcgctggcgccaagtgtgttgaagaaatcaataaatacctgattctccataactctcatcttaagtcccttcaaatcttccggttttgtaatcggacgtacgttgttcgtcatacttctgagtccgttgtaggaataaccaaggcagtggattcctacggcctccagtttctggttaaagtaatcgcccatgtctccgtccatcgcttcaaatgcattctgagcgttgctgaacagccatggcatatccattacaccgaaatcaggagaatatgccactaatacggacgtggaaggaagagccgccgtaagggaacccattgcaactgattccgtaagctccgcatcgccgccgagggcgctgttcggatatatctctactttgattgtgccgcctgatttctcctccaccggtttctggaagtattcaaccagggccttatgtgtggaacggtcttccgcctcaacgtgcccaatcttaattgtcacggccgcagcggtctggcttccctggctatctgccgcttctcctccttcggctgccggagcctgtgttgctgccggctggtttcctgcatttcttcccccgcatgcgctaaggctcaaagccatcactgctgtcagtcccagggcaattaccttttttgtttttttcatcgtacatcctccttaaattctctttcacagaactcttctaccctcttttgaattatctataaaatttcaataattccgttatcagcgtcaaccctgattctgtctccgtcttttacatcctcataaaaagccgggtcaaccttatccaccatcggcacttccatgatgatggcactcgatacaagcactgtctccggatactggacaatcattgccgccggcatgttctggttcatcttaagctggtataaaccatccgcctgtaccactgagcttccctttccccccgggaagatcaggactttctttgcaacgctccgtccttccagatcatgcgctttctcaattacttcccctgtctccggattcatcagatagaacatgatatggtcctttgacacgattgcttctgcctctgcgcagccctctgatatcttatgacaactgtattttttcatcttactttacctcccctgttaatgctgcatcgatacaggtatccagatcgcggataacgaaatggattcctcttctctgcggataatatgcgcactttggtgactccgtcacgcctattttgccgttcaggtggcgccagcacggctggtccggacaggaatccggtacgatgaagccgcccgcttccgtgataatctcgtctaatcccatacgctccgccatctcttttaccaggctggaggtcagtatccacatctctttttccagtttctttcccttgattttttctgcgatatgctttacttcttcaagtgtaaagtgcggacatccgaacataacgaaatcgatgggcctgttgccttccagggaaatctcgttaagaatttccgccatatcgtcgttggtgatgactaccttccgctccggctcttttcctccgaatgccgtctccatgtcgggcgcctccggtgttacgccgagaatatgatacattccgtaagcgccggaggtgttcagctccgctcccaggttcctgagcgcttccttcgtgatagtctctccgggaagaccggtaaatacagggattccctccccaatcttcttacccagcattcccaggatgtggtagtcgtaggcggtcttcatatctgcctgtacctccaccaggatattgccttttctgttctcatccagcagaaggccgtattccggcacaaagcctgtcacggctgcacagagcgcgctgttggcgccctcacggttgcttctcgctccccatacggaattgacatacggtgttgcgctggactctgagaatgcaattacctctttatacatcggaacatttgtgtctatgtaaggggtacagttataagtaagctgcgctccgattcccttatatgcattatgggttctctgcattaaatcggcgaatttcggatccaccatatctctctttgtgaagaaatcatagcagaagcccgggttaacggtcggagccacacggcagtgtgcgccttcgctgagcagcttctcgcagaaccataagtccgcctcctgattggagagagccacatgggccctggtgatgggcaccatccgctttgcgtcaaagcattcgccgatggctacctgaatcttcatcgcgtatgctgttccctttccatactttccatccagcatatcctgctgttcctgtgtcagtttcataaaaacctcctccttaaaattatcatatatagttatggttcaacttggttatcagctttttacagtatcctgattctctcatccggcctgatatcttccagtacggtcttcgatacctggatatattccagttccagtgtgtttttaatctttacgatacgtaaatcttctttctttacattccggatgcacttgatggctacacgcaccgcctcatcctcatcggccgctaccagcggcacacggcagtcttcaatacagcggcatgcaatggcgttggcatacatcgcttcgtaatcgagctgttcaaagacttctttcaccgttacgtcaaagagtccgattccgatggcattgccatgggactgtggtgtgactcccagtaaaaccatcctttttatctcgggaaccggaaggcaaaattcttttaatacggaacttttccccagaatattcgggtcgtagccggcccctgaaatattctttccaatctcctctacaatcagtacgtctattttcggcggaatgagaaccggcatcttcgttctggcgattttcaccagttctttctcccgtttaatcatattttctgccgcaaccgcctcaatcataaatgtctcgtcataggcattctcaatggcggcgatgccataggcaattctgcatttcttaagtatcagactggcggcatcctctataattgcggcaaattcatcgggatcctcctcatggatggaggaacatcctatctggttccccagaccgattaccagcatcttgcaaagaccgctctgcaaatcgcctacaaagtccgtgtgcagctttacgcggttaatgggaataaccgcatccgcttccatcgcggccctgtcaaaatacacgtccttgccggaaggagtcctgcccagatgattcacatcaaccgtggtgacaatctccactccaagattttcttctgtaatcccgtaactggcaagcacttctctctggccttcctccgttccgttgccatggctccccatagccgagactatataaggaatcccgcccttctttcttacatcttcaatcacggttctgacaataagaaaaaggttcttaattcctctgctccccacagcgaccgccacccggtcgcccggatgaatctttcccgtaatctctttcttcgccagctctctcttcagagttccctccacatcttccagcaaagtcctgtcaaaaatctgctgtactttgcagagttctggcagcggatatgtataatcctcactcagtaataccggcataattccctccctgacttcaagcctgcatctcacatgtatttcacttgtataatctaattatacatatttattttccattgtcaactgaaattgtttgccataaataaattattttcagatataattgtatttaattgtaagttaaattaacgcaatggctcagacaggtctgcgcattaactgcgcggactgagaaaaggtagtggcggcaggcatccggctcaccgcacagcgatttttatatacaaaagctgctgaaatcaggccgcattgcgccgtgatttcaacagcttttgtatattttatgaattttctcataacagttcttaaactatctgccataaaccatcctgatccgttccatggcctcggccgtattcgctttagttccaaaagccgtgaggcggaaaaaaccttcaccgtttttaccgaaaccgcttcccggtgttccgaccacatgggctttatcgagtaaatcgtcaaaaaactcccaggatttcatcctatccggacactgcatccagacatacggggaattttttcctcccacatgccagattccaagggatgtcagagtgtccgtgataatcccggcgttttcctgatagacatccagatgtttcctgcactctctcagcccttcaggtgaaaatgcggcctctgccgctctctgtaccggataggaaaccccgttgaatttcgttgtctgacggcggagccacattttcctgacagacattccacctctcatgagttcctccgaaatcacagtgtaaccgcagcgcgttccggtaaagcttgccagttttgacagcgagcagaactcgacggcgcatgtctttgcgccttctatttcgaaaatacttctcggcaggctgttatcgagtataaaggattcataggctgcgtcaaataaaatcactgcgtcctgttcattggcgaaatcaacccattccttcagctgtttcctgttataaacgccgcctgtggggttattgggggaacaaaggtaaattatgtctgccctctgtccctggggcggcagcggcaaaaagccgttatccacattcgcatccagaaatactatctttctccctgccatgatattcgtatccagataaacgggatagacgggatccgggataagtacggtattatcctgatcaaacagatccaggatattgcctaaatcacttttggcgccgtcgctgataaagatatcgctcgccgcagtatgcaccccgatactttcatagtaggcacagattgtgttcctgagaaaatcatatccctgctccgggccatacccatggaaagtctccgccttcccctgttctgctgccgcctttacgaaagccgccgccgctttttcacaaatcggaagcgtaacatccccgatacccatacggataatctgagcctgcggatgtaaggcagtatactcttcaaccttttttgcgatttttgaaaataaatagctttccggcagatttttataatttgaattaattttcattaactttcctccttttgtatcagttaggtttcgatgtggcttttataaattcgcgaaacagcgggtgtgccctgttgggacggcttttaaattcaggatggtactgtactcccacataaaacggatggcccggcacctccatggcctccaccaggttcccgtccggagactggcctgaaaacacggctccttttgccgtatactcgctgcggtagctattattaaactcataacggtggcggtgtctttcgctgatttcttccgacatataggcatgctccatttttgttccaggcgtaatcctgcatggataggctcccagccgcatagttccgcccttctgctcctgtcctatctgctcttccatcagggcaataaccggatggctgctctccgggtcaaattcactggagttggcatcctcgtatcccagaacgttccttgcaaattcaattgctgcaatctgcattccaagacaaattccaaaatacggcaccctattggtccttgcatattccgccgccgctatcatcccttccgtaccgcggatcccaaaaccgccgggtaccaggataccgtctgttccggccagaagtttcggggctgtgacccgtgtcaggctctcgctgtcgatccagttgatattcacccgcacgccgttttcccagcctgcatggcggagcgcctcgacgatggaaaggtaggaatcatggagcttaacatactttcccaccagggaaaccgtcacttctccggtactgtttttgatacggtcaagcatctcattccactcgctcagatcgcattttttttgtctgtccgaaattcccagctcacgcatcgcaatctctgccagtcctgcattttccagcattatcggagcctcatagagaacgggcagcgtcagattttcaatgacacagtcctcctttacgttgcagaacagggcgattttcttcaggattgacggctccaccggccggtcacaccgtgccacgataacatccggcataattccgaatgactggagctgttttacggaatgctgggtcggctttgacttatgttccccggatgactccaggtagggaatcaaagtcacatggatgaagagacagtttccacggcctgcctcgtgggatacctgacggatcgcctcaagaaacggctgggattctatatcaccagtcgtaccgccgatctcagtaataacgatgtctgcgtccgtctgttcctgcacatgatagataaaagacttaatttcattggtaatatggggaataacctgcaccgtctcccccagatattcgccttttctctctttatttaatacattccagtagactttacccgtcgtaaggttggaataccggttcaaatcctcgtcaataaaccgttcataatgtcccaggtccaggtctgtctccgcaccgtcttccgtcacatagacctctccgtgctggtagggactcatcgtaccgggatctacattgatataaggatccagtttctgggcggcaaccttgaatcccctcgcttttaaaaggcgtcccagagaagccgccgtaattcccttgccaaggccggatacgacaccgccggttacgaaaataaattttgccatctgctttcctcctctataatcgttattattcacggccccgcaaaaaagcgcggttccgcgaacggtaacctttaatctgcatgtccctgaagcacatatcccggaatatggatatcctccgcattttttatctgccgcgcttcatcctgatctgccgccccatggacaatatgggcgatatcgatcagttccacattatcttcatcgtatttactttccaggctcagcgccagaactgccgccgtatcaagggaggtaaggcagggaatcccaagctccaccgcttttcttctaagccttacactgtctcggtccggctggcggcccgtgaccgatgttgacagcacatagctgatccgccccttctccattacggaaatagtagtctcctccccttcgtccgcttccttcggttttttcacgatggtagaggaaatgcctgcgctgttcagctttctggcggttccttccgttgcatagatggtaaatcccatagagacgtatgcctttgcaagctcttttaagtcttttttatcggtatcgcggacactgataaggattccgccgtttctcttcatataataaccggcggcgatcattcctttgtaaagagcctcctccatggttcccgcaatccccagaacctcacctgtggatttcatctccggcccaagctgggtatcgacgtcggacagcttctcaaacgagaaaacgggtacctttaccgcataatacggagatgagggataaagacctgtttcatatcccatctcatttaatttttcacccatcataatcctggtagccagatccaccatcggaacccccgtcaccttgctgatataaggaacggttctagatgaacgcgggtttacctctataatataaatcgtatcctcatgaagaacatattgaatgttaatcaacccttttgtccccagggaaagggcaaggcggatcgaataatccacaatccggtccttctggctctccgtcagcataaaggcgggatatacggcgatagagtcaccggaatggacgccggcgcgctcaatatgttccataattccgggaatcaggacatcctccccgtcgcagattgcatcgacctccagctcggtccccatcaggtatttgtcgatcaggatggcattttctattttgtgttcaaggataatcttcatatattcatggatatccgcatcatgatacgctatgatcatgttctggccgccgagtacatagcttggacgcaccagaacggggtatcccagccggtttgccgtcgcaattgcctcatcctccgtataaacggtatcgccagagggctgtttcatattgagttttttcaataatgcattaaacctgcccctgtcctcggccatatcgatactgtcggccggagttcccagtaccgggaccccgttctccaccagacatttcgtcaggcggatagccgtctgtcctccaaaggccacaacagcgccggccggtttttccacccggataatgtccatcacatcctccggcgtcagcggttcaaaatagagccggtcggcaacgttgaaatcagtggacaccgtctccgggttattgttgacaatgaccacctcgtaccctgcgcgcttcagtgaccaaacgcagtgtaccgacgcatagtcaaattcaattccctggccaatgcggattgggccggaaccgaacaccataacaacctgttttcccgccgcatgttccatgatgaacggccctgcttcatcttcctcgccgtaggaactgtaaaagtatggtgtgctggcggcaaattctgcgctgcaggtgtccaccatacggtaacaggccgggatatgtttcagctctgtcagaccggtcatctctttaatgacccggtccgggaaaccgtactgctttgcttccatatgaagctcttctgtgaacaattctccctgcattcttcgctccagcgtcagcaggtgtaacagtttatttaaaaaccactcgtcaatcccggtcagttcgtgaagccgttccaccgtcataccgcgcttcatgctctcatatacggcgaagagacgctcatcgtcctgggaaagaattttctgctccagctcttcccctgtgagaggctccatctttttcatattcaggctgtcctgggaaatctccgctcccctgactgcttttaaaagagcctgctcaaagtttctgccgatcgccatgacctcgccggttgccttcatctgtgtccccagcttccttctgccatatacgaatttatcaaacggccactttggaaatttgaccgccacatagtcaagggccggctcaaagcatgccatcgtctcccccgtcacctcgttcggaatctcatcaagacggtagccgacggctattttcgtcgccacccgggcaatcgggtaaccggtggccttggatgccagggcggaagaacgggatacacgcgggttcacctctattaccgcatactcaaagctctcgggatttaatgcaaactggcagttgcagccgccttctatccccatcgcctgaatgatattgagggctgccgagcgcagcatctgatactccttatcggccagagtgactgccggagcgataacgatggaatcgccggtgtggattcccaccggatcgaaattctccatcgagcagacggtaatctcgttgccgacgctgtcgcgcattacctcaaactcaatctccttccatccggcaatgcatttttccaccagtatctgatgaatcggcgacaggcggatccccgccgtggcaatctcatcaagctctctccttgtctttgcgatgcctccgcccgttccgcccaatgtaaaggcaggcctgacgataaccggaaatcctattttttctgcaaaagccattgccgcatccactgtcgttaccacttcagacggaattaccggttccccgatttcttccatcgtatctttgaagcactgtctgtcctccgctttatcaatcgtttccggggatgctcccagcagggtgacgccgcggctctcgagaaatccctcctttgccagctccattgagagggtaaggccggtctgtcctcccagagtggacagaatgctgtccggcttctctttatcgataatcctctttaccacttcaagcgtcagaggttcaatgtagacctgatccgcaatggcgctgtctgtcataatcgtggccgggttcgaattcaccagcaccacctcaagcccttcctccttcagtgcacggcatgcctgggtccctgcgtaatcaaattccgccgcctgcccgatcacgatggggccggaaccaatcaccataactttttttaggtttttatttaacggcatgacgcttcctccttgtatttctccatcatcttgataaaccggccgaataattcttccgtatctttcggacccgcgcatgcttccggatgaaactgaacggtgaaggcaggtatatcacgataggtaatgccctcgcaggttccgtcgttgacgttgataaaagtctcctctgctccggccggaagtgactccctcagtacttcatagccatgattctgactgctgatatagatacggcctgtctccaggtccttgacaggctggttggcccctctgtgcccgtatttcattttgcctgtctttgcccctctggcaatggccagaagctggtgccccaggcagattccgaatatcggcctcttggccactgccagttttttcagttcttctataacacgggcgttgtcctccggattgcccggaccgttggacagcataattccatccggatccagggccagaatttcatcagccgtagtcgatgcagtcgcatcatagacatcacagcctctctttgtaagttctctcaagatattttcctttgcgccgaaatcccataatactacccggtaatccgctttcccatttgtcttaatgagatggcagccggccggtgtcacgctctcaacggcagaagtaatgcggaaatttcgtatttgctccagctcctccggcccgtacggcggctttttcacggtcagccttccgttcatggaaccgtattcacggatagtctttgccagctttctggtatctattccgtaaatggcgggaacctttctttctttaaaaaaagtgtcaagattaccgctgctcctgaagttggaggggtcctgacaccattcttttacgatatatgctgataagtatacttccttgttttcaaaatcctgcgggatcactccgtaattgccaatcattggaaacgtctgaacgactatctgtccataatagctgggatccgtgattgtctcaaggtatcctgtcattccggtcgtgaacaccacctctccggtcacttcgtctaaagaggctccaaatccttttccttcaaaatatttgccgttttccaaaagaagatataccgttctttccatcctgtcaccattcctttcacctgtgcttttatcctccagaagctttacttctattttgtacagcagcagctttctcatacatatgcaatcttcgcagagcgttttttatttcataggacgtacttttttaaatgaaatgaaaaaagacgtccatgaggccaaacctcatgaacgcccttgttcatttctggtgaattatagcatagagcgaaatctgcgtcaataataaattttaaaatttttatattatttaacctgacggatgatgtatcggatcacgcgctccggcttgttacggttgctcctcacaggagcccggcagggaaggcagaatgctctcccgatgtcttctgtaatagataactccggccgcatcggccagaatccagccgattggaattgccgcccagataccatccacacccaccggtccggccagcgcatatgctaaaagtacgcgggttccaagcgatatcacggtaagcactacagacatagcaggcgcttttaccgcgcggtagaatccatacagaaggaacagacagccgattccccaatagaatgctccctcaattctgagataacgcactccggccgccagtatatccgtttcatgcggctggacaaagataagcataagctgttttgccgacaacagtaccagtgcggaaatcagtacgcagaacagcacagaggtaaccgccgcctttttaatcccttcccggatgcgttcatgtttaccggctccgtagttctgggacacaaaggttgaaaacgcatttccgaaatcctgcaccggcatataagcaaaggaatctattttgacagccgcggcaaaagccgccataatgacaggcccaaagctgttgacgagaccctgtaccatcagaataccgaaattcatgacggactgctgcacgcaggtcagcaccgacagcttccctatatcgcggagaatctccggattacggcagaaatgccgccttgcgggcctcagctctttacagcagaacaccgtatacaggaatattccggcaccggatacatactgggcaatcaccgtagccgctgccgcgcccccgacgccccaggaaaaccgcagcacaaacaacaggtccagcgcgatattgagcagggctgagacggccagaaacaccaggggcgtaaccgagttgccaagggctctgagcaggcatgcaaaaaagttgtaaaggaatacggcggccagcccgatgaatataatccacaggtattcgcgcatcagagcatatacctcgtccggaacgcgcagaaaaatcattatcggatcaagccacagatagaccgctatgtacaaaattaccgtcagcagagaaatcaggccgaatgcctgaacaatgccggcccgcagccgttcccggctgccctgtccctgatagatggcgaataaggctcccgctcccattgacattcctaaaaggatcgaggtcagaaatgtcataagcgtgtaggccgatcctaccgccgccaatgcatcgcggccgagaaactttccgacaatcaatgtatccgcaatgttgtaaaactgctgtagcagattcccggctatcatcggcagggagaatacgagcagtgtttttgttatatttcctttcgttaaatcacgatacataccatcacctgttaattttataatttctatatgtcatgaataatagcatataagataacaatacgcaatcattttctttcaatttgacacgatataaatgttatgatattctgattaaaagaacgattattatgaggtgatgcgatgtacttgagcggattagacgagctggaccagaagatattgcagctgcttattgaaaatgcccggtattcttattcggaaataggggagagaataggagtttcacgtgttgcggtgaaaagccatatcaatgcgctggaggaacagggcatcatcgaggaatatacggcggttattaatccccacaagctcagcggggcgatatcctgttattttgaaatagagacaaaaccggagactttctctgaggttacgcagatgctgtattcctgccctgtcgtcacgcagatataccgggtaacgggaaactgccggctgcatgtacatgctgtcgcggcaggtcaggacgagatggatggattcatctccggaacgatagaccggctgcccggagtcgttaccatcagtacgaatgtgattttgtcgcgtgttaaggatattaaaggactgcgtctgtaaaaagaagggacgggagaactatgagtgaagtattggaatttgcatgcagaaatgattttagaaactggctccgcgagaattgcctgtccgacgccggtgtctggctgctgttcggcaagccgggcggaccgcaaacagtgaaagctgatgaggctcttgaagaagccctctgcttcggatggattgacggccagatgaagagcatgaatgaaacatcttatcggaaatatttttcactgcgcagggataacagtaaatggtcggaaaagaacaaaaagctggtggaacagcttgaaaagcaggggattatgaccgactacggcagaaagaaaatagaagaagccaaaaagaacggccaatggaacgcgccgaaagctccggcaataacagaagaagagattgcctctgtggctgctctgctggaaacccatgaacctgccttcactaattttcaggccatgccgccgtccgtcaaaaagacttatacgcgtgcttatttggatgcaaaaacagaggccggacgggagaaacgcctggcttggatgattgagcggctgaataagaatttgaagcccatgtaaaataatctgcggcttcacgataacctgcagtctccgcgcacaggccactgccatcgatatgaagaaagaataggaaccagattacttaaaaacacaggttcctcttctttctgtactgtttctataaaggatctcacccaatcaaactggtcaaactgccaatcttctcaatcctgcattccaccttatcccctgccttaagatacttcggcggcttaaatccaactcctgctcctgccggtgttcctgtcgaaatcacggttcccgccctcagcgtcattcccttcgaaagctcgctgataatatgggctatcccgaaaatcaaatcgccggtattggcgtcctgccgaatctctccgtttactcgtgagctgatggaaagcctgggaggaaattcaatctcattcgccgtcacgatccacggtcccatcggggtaaatccatccagactcttaccaaagtaccattgtccatggcgattctgcatgtttcttgcgctgatatcattaagaattgtatagccgaagatatactcgccggccttctcctccggcacatccttcgcatcttttccgatgatgaccgcaagctccgcctcatagtcgaggccatccaccagccccggataggaaggaatcgtctctttatcgcccgatgcgcggttgactctctttccaaaataaacggcatactcctgttcttctttataagctcctttcaggaaatcactgctttccttcaagtgatccatatagttaacacccagacatatgatatcctgctccggattcgggattggagccaacagtctcacgtcctccagaggggtagcgcctctgatctccgcctcgtagggctgtttgcctgctatatgctcggcaagctggatctccgaatcgctgatttcacgaatcagctccttcatatcccggtattccatcccaatggcttctacaggataaatccactgctcatcatcgctcaggattccaagcctctccctgtcatctatctgatacgtcaacaccctcatttcatttcctccatattatcaagctcttcatttctaaaaagctgccgccccatcctgcaaatggaaaaggccggcagcttcgcctttgaaactgttcttcttttatctgattttctcaggaaaacccacttttttctgaacttttctcagtgtcttattggaaaaatactgcgccttctcggcattgcccttgattacgccgtcaatataatctttgtttttagagagatcggcaaaacgctcctgaagcggcttcagcacagagactaccgcctcgcccaccgcaagcttaaagtcgccgtagcctttttggtcaaattccctctctgtctcctgtgccgtttttccggtacatgcacagtagatatcaatcagattcttgattccgggctgctcttcactgtagcggacgcaagcctccgaatcagttaccgcgcgtttgaacttcctgataatcgtatcgggatcatccatcagatagatgcttccgttcggattttcatccgatttcgacatcttcttagacggatcctgcagactcattaccttcgctcccgcttttccgatatatgcctccgggacagtaaatacatcaccgtaaatattattaaaacgaatcgcaatatctcttgtcagctccagatgctgcatctggtcaattcctaccggaaccacatccgcctggtacagcaggatatccgccgccatcaggaccggataggtgaatagtccggcattgatattgtcagcatgctttgccgacttatccttgaactgggtcatccggctcagctcgcccatataagtgaaacagttcaaaatccatgcaagctctgcgtggccgctgacatgagactgataataaatgcagtttttttccgggtcaagccctgccgcaatataaagcgtcagaagcgttctggccctcttcctcagttcagccggatcctggcgcacagtgatggaatgcatatccactacgctgaaaaaggtctggtattcatcgctgatggtaacccagttctttaaagctcccagataattgccaagtgtcaggttccctgtggcctgcatgccgctgaataatgtttttttaccgtctaacataatctatctccttctaattcaattcgccttgtaagtcttcctgttctgccgcagttttgcaataaccgctctttccagagtatgtgcgtttttgtgaccaaccgctttgtaccactcacatggtattatgttttgtattatgttttgtgtcattcgaggttattttctgaaaataccttcttattataatacagaagctttcctcttgcaagccgggctttcagatttttccatcggagatgttaaaatccgttactgttcacacggttatgtcccgcgaggtgttttcgtgtgttttctgcgcgaaaatcccgagttacacggcgcgaaactgcgttttatgcagtttctgtgcatctcgaagcgtgttacagttcgcagcacgccgctttctggcggagtgtgaactgtaactaaaatccttattctgctgccttcttgcgttaatatgaatattctgataaaattgtttcaacggaaatgtattgtttcaatccacgcacggtatattgtcgaagtgcgactgcatcctacgtagatgcgtggttgacctcatggcagtgggggataccgattactctccgcccaccactgccgttaagtttgtttttggcaattcatctcaccaccttagaggatgggagaatccttactaactttgttgaactttgaaaggagtacttcatctatggataaaacgatggacaaaatcgcaagctttaccattgatcatctaaagcttttaccaggaatttatgtctcaagaaaggatcaggcgggggacagcctcattaccacctttgatataagaatgacccgccccaattatgaaccggtcttgaatacggcggagattcatacaattgagcatctcggagccacctatctgagaaatcatgactccatgaaagaccatgttatttactttggcccgatgggctgccgtacgggtttctaccttcttctgtccggtgactggaactcggcggatattgttccgcttataaccggaatgtttacatttatctccggttttgaaggagaggtacccggagcctgcgcaaaggactgcggaaattacctggatatgaatcttccgatggcaaagtatgtggccggcaagtatttaaaagaggtattggaaggaattgacgaaagccggttaatttatccaaatgcataatgtaattgcctgtaagcgctgcgcacaggtcaacctcttcaataacttctatatgtgagaatctcgcttgcgaaattctccgcctgcggcgggtcgctgcggcggcattattccctgccgccgcaggcattggctcacttagcgggtgtaacgggcttagtgaacaagcgctctttagagttgcgctcctccgcggagcggtttttatcccttcaccagccccgcaatccatctcagccagccgctcaccgacgaagctcttcttcctgctacgctgctgctgcaaaggccctgttctacaatgcacttttcaatatacctcttatccggtatctcccctgtcctcagaacaattccgaataaatcatggaatattccgtgttccagaatcagttgtacgtaccgtatctgtctggccttataattgagcttcagcaggctgcgcccccttgttgttatcgtcaccctgacgttccgctcctcatccttctcctttacggccaggccgaggaaacggcaggcgttaaaataataatccgactggcgctcccggaatccgaacacctccgctatctccgccggggtaagggctctgtcattgagatgctccaccagagaaatcaccttctcaaagctgtccgcctggataaacactacgggaggttccggttttaccgccgtacgctcccaggcctccctgagatcctgcatggaaatatcagtatcctccagactgtaaagtccctctttcaccagacgtatcgcattatagcatgaggagtcggtaaattcgtactccagcaaacggaatatattattagaatataccataaaaacgggcctgaccggtttggccagtttcccgttccagagcctgtagggatagtagagctggcgaatcaggaaattgctatgcaccacattctttccctctatcatggcgaaggtatcccgatcttcaaatcctccgtcaatctcgacctgcgaattatttaccgcaatctgataaccgtttatcccgtatgtttccggcgctttggcgcccgcccttacgggattcacctgaaacgtaaatttaccggaggccatccggccggataccgtctgcttaaagttctcaccgcccagaaagtcatccagaataccggaaatccccataacgttgattgctccggcttccgaacggatatcattgatatcaatcgtctcataataatccgggattgccgccttctttacaccgggcacacgggtccccgggaccaaatttcccggccctccctgctccggaaaatctgcatagagatcaaaatcccctatcacataggttccccttgtcaccggcaggatgcccagacggctgccgaagacggagggaagcgattccctcgtatcaaacttcgtcatcagcctcggctctttatactcacgaatctgatcggccgtaatataaaaggggccgctctccgacacctttttttctatatcatatcggtcaaagagcagcttccacttatcatctattatgctcataatttctcaccagcacttcatcaatagccccgcgtttatcgcctttcgcattgattgccctcttcgcggcaacgcgctccacaatgtaatctttgtataagtcctctatgaaatcacagcaggaattggacagcaggaaattgattcctttcttactcagcatatcgcactgcttcttaagctccctctgctgctgctccccaaatccggccgccgtatatcctgtaaaggaagaggaggtgctgagcggcatataaggcgggtccagatagacaaatgagcctttcctcagccccttcagcgaatccctgtaatcgccgcagcgaatcgtcacattcgccttatttaaataaccgctcatcgaacgtatcgtcgtctcattcgtaatattgggattcttataccggccccagggtgaattgaactctccggcgcggtttacccggaacaggccgttgtagcaggtcttgttcagataaataattctggccgcctgttccaccggcgtcatccgggaatattgctccctgtctcggtcaagagaacggatttcataaaagtattcctggcagttgttttctttatggcgttccaggcaggcgatcagttcctcgggctgcgacttgatcactttgtatatgttaatcagttcggcattggagtcgttgattaccgctttcacaggctgcagatgaaacagaaccgcgcctccgccgacaaaaggttcatagtatgttgtgtattccggtatcagcggcacgattgtatcgagaagctgcctcttgccgcctacccatttgagaatgggcgttaccgccccgtctgttgtagacatagattcctccgtacgtatgtttgaaaagtcttttcctattataacctgtatcgggtgagaaagcaaagagttcctgcaaatttttccgtcctcaacaaaaacatcgtaacagtacagacagggagcggttctaaaatggagatttaattaagcaggtgaggacgccgccgcaggccagcggacggggtggtggggtgtgtatatgagtctttcgtcccggaggaagattgttgtggtttggggctgcgggcgaagataaagtctgcggagcacactcccgctctgtgaaatgcatcacgctgctaagctcgacaggacctcgctaatcagcgatggatttcaacggcatccgcagactttatcttcccctccgccccaaggccaggttttcgacaggacgaaagactccgccgggtgtatcagccccgtccactggcctgcggccgctgaatgtctcacgcgttaagtgcgggggcggaccttgtcgcggccactcagcgctaccgtgtacgggaaatacgatatgccttttataaaaaattgtggaggatttgatatcagcctgccggaaacacgtagtggccgcgacaaggtcctcctcatttaaggttggagacaatcagcgcccggaacggaccatgttcggtgccgcaaaaatctccgcctgagtcttccgtccccggcgataacctgccccggggaagtaggcggaatcaattgcggaggggacatgggagtccgccggtgcttagcgaggttcctcacgagcttagcattccgatgcgcactccaaagagtgcaaacggtccccgcagcaattcattccggccggattccccctccacggccaacctaacacggggacggaagactcagccatccccctcaccacaccggacatggtccgttccggacgcgtcctcaaacctcagttaaatctccattttggcaacagcgccctgtctgaactgttacaaaacatccgtgtgaacagcaacaaacatcccgcccaccggcgcttacaataatctttctgccgatggacgggatgtccccatatccaaattttatgattttcttccatgatattttgggaagcatcttttatcagattttataatcggattttctcttcgggatttttatttcataataatcccagccagcttctccgcatagtctttaatatcaattccctttgtaaagttcaggcatgttcccgttgggaatctggttttgtcaatccatgccgccggcattgctttcgcgccgtatttagctcccaggacagttcctgccacagctccgatggtgtctgcatccctgccgaagttgccggccaccacaacgcccgtcctgaaatctttattgaccgccttcaggcaggcaaatgcggatggaattgcctctgccgtcgtggcccaggtgctggttcttaagtcgtcatggagctgcatccacacatcgaaaatatgtccgtcggcggaatctaccagttcaaatgcatggttcattgaataatagagccaggactcctccggaatcaccttcattgcggcatccagaatctcatccatcgtaccgtccaccatggctaccgatacggctgcggctaccgcctgcgctccccaaacgccgtcgcggaaatggcttacctcggattcaatctttgccattgccgccgctttctccgggtcaccggcgcaaacgatgccaatcggcccgatacgcatcgcggatccgtcgctcatgtggaaggcattgtatttaccggacaggggaggaagaaaacctcttctcaaattattagctgcttcaatctcgctggcaccgccgcgtttaaattcatcctgtattgcaacatcctcaagccaggattttaccacttcttccgatgtcagctccccaccgcagcgaatcagggtttttgctgtcagcagtgcgaattccgtatcatctgtactccatgaagccttgctgttaaaatcagttgtaatagcataattttcacggttttcctgctttcttgaagcatctccaaaagaatctccgattgccagtcctgataaggaaccgtatgccttgtcaaataccagctccggatttttcttaaactcttctcttgtcagcatttgtcatcctcctgtttacctctgccgattttttatttaaatatacttacttttttatatataatccttccggattatcatcacggatttcccagttcttccactaagatactctcaaattctgttccgcctgcttcatcccattttgccgtcatctcgtcgaatgcatcgattggttttactcctctgatgatatctgcggagtactccttataatatcctgtcatcgcatcccactgcggcgtcatctcttcaggaatcaggatgttgacgtcctgaacaatatatttctcaagattatcaaacgcgctctgtccgacagtcgtcagtaccggctgtgcaagggacggattctgcgggtcaaagttatttgtcgtatcccagaagcgtgcccaccattccggccatctgtctgtaaatacaatcttgttatcctcaactgtataatgttttccttcaattccgaccttgtctaagattctgccttccggactagccatgaattccagcaccgcccatgcggcatctttattcttggaatcgatgttcatcgcaaaaccgcgctcttcttttgttacatcctctgccctgtatccctgtgccacaccttttgccggaggaagaatcacaagttccgactcttcgccgttaactgagcgcatcttgttgtcataaatctgggtggaggaaagtgtcccggcgattattcctgttttgccttcgtagaatttctgttccatcgtatcccatgtatcggtcagatattccggatccagaaggccgtccttataaagctttgcatagaattcgagcttattcttttctgcctggctctctttgctgaatatccattttccatcctctttaacgattgttcctgttacgccaaacgcctggttaaagatgctgtcgagacggaccgtactgtcgccggaaccgccgtcggtcgtcattgcatactctacaaggcctttgtctttcatttccttgaacaggttgtaataattatcaacggtcgggtctgcgattaatttctcataggaatcaagctgagcggcccagtcttttctcatagccggaatctggatccgggatggggccagccaaatcaggtatgggtaattctccatacgttttctgttgacgtccgtcataatgctctttataaatgtcgatttttcaacataagggttcaagtcttcaaacagtccctgctgtgccaaagccagatcgccgccctggaaatagataagatctgcttccacatcaccgttcatcattgcaatcggcactgccgtcgcatagcttcctgccggcggttccataaactccaaattgacgtactggccgtgagccgccattttttcattaattgcctcccgtaagagctgcacatcctcctcatccgggaatacgtccttaatcattacctttaccgtaacaggtgcatctgccgtaccgatggccgggaactctgccgttccctctgcctgtgcagctcccccgttatctgcttcgctgccggccggtttggtctccggcgcgctgttgtccgctttgccgccgcaccctgcaaggctggagcctgcaagcgctgccgccataatcagtgccaatgtttttttcatgtcttctcctccattttatttgattttttattacacccttttcatattctcaggctgtctttccattttcccgtgcattactccttcacgccgcccgccataataccttttgtatagtatttgagtaccagcggataaatcagaagaatcggaactactgcgatcacaatcgtcgcatactggagagccgtataatcaatctttgccaaatcgttataattcagcaggttctgtgttccgattatcgttgtgacatcactatccacgataaacttacgcagaattacctgcagcggtaccttcttaatggatgagatgtaaattccggaacggaaatactcattccatcttgtcactccgtaaaacattgtcagtgttgcaattcccggttttgcaagcggcagcaccaccgaaaacaggactctcagatgaccggccccgtcgatcttcgccgcctcgcagagcgacaccggcacatcctcaaagtaacgcatcataatgacaagataatacacgttaactgccatgcagaggataacggaccactggctccccatcagcccgattttctttacggtcatatactccgggacaattccagggtcaaacagcatcatgatgataaagaacaccatcagcactctcttgccgaccaggccgggacgtgtcagcacataagctgccagcgccgtcagtacaatatttaaaaatgttccgaccaccgtgataaagatggaattgaagatggacggcaccagtgtcttgttgctgaacagcacctgatagttaatcagtgaaaatcctctcggaattacttccaggctgctcattccggccgactgaagcggatccgaaagggaacgggccagaatatgcaaaagaggcacaatcatcgtcagtgtcaggagcagcataaaaacagtgagaatcagctgcgtaatgctgaattttttctttctcattcttaccacactcccttccccgtcacctttttagaaacaaggtgagttacaagtaccaggaacactcccacaatgcctttgataagagccaccgccgtcgccagggaatactggccgctttcaagtccgatacggtaaacgtatgtatccagaatgtcgattacactgttgacggactggtttgtaaagttgaagacctggtcgaatccggctgtcataaagaagcccagattcagaataaacatggttgtcatcggtacgacaagggcgggaaggataatataccggatgatgtcgatccgcttcgcgccgtccaccgtggctgcctcataaagatccgggctgatagccaggattgccgtaaagtatacgatggaatcccatccgaggcttcgccagccttccgagaagaacagcacccaccgtatcgtccccttattcgtcataaaatctaccgcgtcgagtccgaaccatcccataatctggttcacggcgccgccggatacagacagcatcgaaatccagataccggcaataacgacccatgaaaggaaatggggcatgtaggaaataatctgcacatacttgcggaacttcccacatcggatttcattcagcagcaatgcgaaaatgacgaaaaacggaaaaagaagtatgtacttcataaagctgataatcagcgtgtttctcaaaatctccataaatgtggatgatttgaatatcatgtcaaaatacttaagtcctgcaaattcccacggccctttggccctgtaattgcagaaagccagcctcatattgataatcggccataccctgaaaatcagaaagtagataagagtcggcgccagcatcaggtaaagtaccctgtctttccacatatgctgcagcgtcttattcttcttccctgctttcttttctacctttgcctgcatacaggctcccccttttctacgctctgtacatttctgtaaatttaagtaaccggtttctctctaattggtattataacacacttgatatatgatatcaattgtatattatgttaaatttatcccccgtattttttagcatattgcactattattttctagtttttccagattgttttttattttctattattttttcagcacataattaataaaccgttttccttatttctccttttttcgcaaagcacaggcggacctctcaatggtcaccgccttcaacagaatacagggaatgggtatccctgttcgagatacccattccctgcagtcctgtgtacactgtttcatttttaacttgattcctattcgtattcgctgtcatacggccgctctttcgtcgtccggcgcagtttcagggttggttccacgaccatgtggctcagtcccacttcctccccctcgataatccgaattatctgctttgccagatgctgggccatttcataatgcggcttggagacagtggagagcgccggacggaatacctccgccagctcaatattgtcaaatcccatgacttctatctcttccgggatctttttccccgcgtcgagaagccctgaaataacgccgatggcaatcaaatcgcttcctgtcatgattgcgtcgaactccaccttcttttccagcagttcctccgctgccctccgcccgaattcaatcgaatattccccggacatcgtaaggctcttatcaaacgcaatcccgtgttccctgagcgcttcctgatacccctcaagcctctgcttggaaccggaaagttctgtattgccctccacatagacaatgcgcctgtttcctccgcgcagcagataggaagccgctttcctggaacctttcacgttatctcccgtgatgcttgcgtcgctgacgctgctgtcgaaggtgcgccccaaaagcaccagcggcacctggtatttcctgtatttctccagaaacgccttgttcgatataccggaacagagaatcacgccgtccacccgtttgtccacaagggacataagaagctgggcttccttctccggattataatccgagttgcagactatgacggaatagtctttcttttccagataatcgctgatgcccctgataatcttaggataaaagaagttagacacgtcaggcaccacgacgcctatcatcctggaacgtgatacggctacccctctggcaagcgcattgggcctgtaattcaactcctctatgactttgcggacccgctctttcgtggcttcgcctacaccgcacgggctgttattaatcaccctggaaacggtggccttcgacacgccgcagatctccgcaatctgagatatactgtattttgtcttgttttccataaacaatcccccgtcttatttaaggttaaagccgggcctcctccacctgcttatcccatggaatggagggtgcagcccctttgcccataacagtaatcgccgcagccttcgcagcctttaaaagtgcgtccggcaccgaattgccttttaccgccgaagcaataaaatacccggtaaatgtatcgcctgccgccgtggtgtcaacggcctcgacacaaaaggccggctgttcataacggttctcaccatcataataaatacagcccctgctgccgagagtcagaaggatcactgcccgcggatatttctcatgcaaaagctgcgggatttcctcctcctttgcctcctgaccgcagatatcggctccctcaatctcgttgagtataaaacagtctaccagctcaaggggcagttccagaagttccccggtcacaggtgaaggattcagatagattttcattcccttttcggccgcctttttaattaatccggcaagtccgttgatttcgttctgaagcagcaggatatcgccctcctcaaagtgggccagcgtctcatccacctgcccgggcgtaatctcctggttggctccgccgaacaggagaatgcagttctggccgtttttatctacctggataatcgtatggcccgacacgccgtccgtctttctcacaaaatctgtattgactcccgattctgccagcagttcaagcagctttttgccgtcatttcttcccaccgctcccgcgtgccatacctgtgcgcctgcgcgcgccatggcgatcgactggttcagccctttgcctccgcagaagacttccatgcccagagagctcatcgtttcaccgggacgaataaaatgatctaccgcatatacgttgtcaatattcagggaaccgaaattcaatatcctcattctttcacctcaacctttctcctccggttactgtccgcccctgccggaaccggcagtctgcggacagcagcttcctgtgtatgaattataagtaaaatcagcaaaagaggtacgccccgtcttcacggaaccgcagccgaacattccataggaaaagctgtcatcctccgcctccagaacctttaccccgtcgacggaaaatatgatgtgtccgccgcggcactccatctgcatcctgtattccctgtcatattcccagtcaaaaccgcattctgccagaaccgtaaaaccaaaatcattttttaacagcacggcttttcccttctcgtcaaagcctgcggcgtagaagcgctttgctccctgggctctcgccgtaatcagatgggaagccccgtggcgcggtatgaccgcagccgaaaccgtataatccgtgccatagtagttacccgtataggcaaacgcctcctcgcaccgcatcaggttcaaggttttgccatacagatcccaggctccatggtcggtggcaaacggcgtgacacagccaaattcctttttctgtttttttatgtctatcgtatacaccgaaggtccggttatcgcaaagtcgtccaggtaaatcaaaccgagactttttttcttggaaggggagtaaccctcaattacgatacccacctcatccacaatgtctccctctacatccgggattgtgaattccacgctgatccactgttcctgaaccagcttgatatagccctgaaggagatcctctttcccgtaaacggtatgtacgtatggcgcaatccccagcgtctcccagccctcccactgatccagataaagcttcatcgatacggtctgccccggatatgcagtcggtgagaatactggactgtatctctcatccgaaaaatcattacgcgtatagaacggcttgtaaaataccttgcactggtcaccgcgcaccatgcggtccaccagaattttaagcgaaccgctgccgctgaaggcctgatcgccggaatgggacagggcgcagaagaacggatcggagactcgcatattatgagtgcttcccggcagttcaaaatcaaaatggatctctccgttcttaaagctttccgccaggcaggcaggcgcttcttcaccgctcaggcggtatcccagcagcgccagttccttagaaaaggtcggaatatcaaggatattcagatagccggaaataccggagcatacaataccgtcattgacaggtttcctgtagcgttccggaagacctttaaggccgcaggccacgccgagaaccgttcccacattgccggcattgcagtccgtgtcccagcccgccatagtcgctatctcaaccgtcctgtcgaaccggccttttccgtatgccatagccatgaagcagacgcctgcattcgggataatatggcatacaccctgatatttatcatagccccagtcacgcaccagcatctcatagcagctccgccatgactcttcctccggatgggcatgatagaactcaagcacagccgaagccacctgatgatacaggctgtcctttggaatctgcgcaagtcccgtctccataatttcaaatatatcgtcggtttcaaatgctttggcaatggcagcacagaagaatctggcccctaaaacgccctctccgccgtgggatacactggccgctgcttcgccgtaatgagccgctttttccggattgcaggggtttaccagtccccaggtatcgataaagatctggccgccaatctgctctgccagaatcaggccgttctgctccacagagccggactggggcgcttctatgccgttcttcaggttcaggtaagccgtatgctccgtgctgattccatagccgccccaccagaacatgccaacgccttccctggcataatttaaccaggccctggcgacatcctgagggaccagttccctgtccttcgcatcatcataaagagcccggataaagaaaaccggcccgttggcatcgtcgtctgcggcaaaattcttaaattcttttacataatctgtgatttccccatatgtattccggatcctgtcatacgtccagatggttggctccaccggggcgcccagacggataccgatattcatccccagaaatcctgaatacaccttttccagataatcttttaccatttttaaatgtcctcctgtgcgatcccgcactcgtctagtttatcatgcctttggtcagagaaaccggttactctaattataatagattctatatgggaatgcaagcaggaattgcacgttactattcacacggttgtgtcatttagttgacattacagagaatatggagatttagttaagcaggtgaggacgccgccggtacggccagcggacggggtggtggggtggggttatgagtctttcgtctcgggggaagattgttgtggtatggggctgcgggcgaagataaagtctgcggagcacgctcccgctctgtgaaatgcatcgcgctgctaagctcggcaggacctcgctaaacccccatgcctctgattcggcaccaccataaatgaaactgcgagggcggcaggtgattgaaattgccgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgtatgagtgcgcgcaacattctggaataccttctcaccggagaattcttcgacgaagcaaagtatgatgaaatgtataaacagaaaattattgcccacaatctcaaagccagcaaggaacagattatcgatgatttaaatggtgtcatgaccccattacaacgtcgaatgatgaaagagctgctgtcccatctggatgaactcaatgttcatatcaacaatctggaagatgagattgataactttatgaaaccggaagaaaaacaagcgacacaagcaatccaggatgtaactggtatcggaaaaaacagttcccaggccattatttcggtgattggtacagacatgagtcgttttccaaccgccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacatggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatggatttcaacggcatccgcagactttatcttcccctccgccccaaggccaggttttcgccgggacgaaagactccgccaggggtatcggccccgtccgccggcctgcggccgctgatagtctcacgcgttaagtgcggggggcggaccttgtcgaggccactcagtgctaccgtgtacgaaaaatacgatatgccttcaaaacgccttttataaaaattgtggaggatttgatttcagcctgccggaaacacatagtggctgcgacagggccctccctatttaaggttagagacaatcagcgcccggaacggaccatgttcggtgttgcacgaacctccgcctgagtcttccgtccctggcgaaaacctgaccgggggaaggaggcggaatcaattctggaggggacatggaagcccatccgtgcttaatgaggttttttcgaatttagcacggctatgcgcttcgaagagtgcaaacggtccccgtaagaattcattccgaccggattcccccctcacgacaaccttcaaccagggatggaagactcagccatccccctcaccacaccggacatggtccgttccggacgcgtcctcctaacctccgttaaatctccatcgaacagttacattgcacaactccgcctcttgctttccaggagaaacctttctataataagagtaaaagatgttactgttaacacggtaatgttccgcggggtgtgaacataacagttcatgctgtctgaactgttacagcttatcatattaaaggggaatgtatccatgaaaaagatattgattgtagatgacgacaagcgtgtcgtgagaatgctggaagaatatatgaagctctataatttccagaccctgtgcgccggaaacggcaaggatgcactcgcgctctatgatgagacggtggatctcattatcctggatatcaatatgcagggaatggacggagtggaggtgtgcaggcggatccggaaacagggaaatgttcctatcatcatgctgagcgccaacgctgcctcctttgacaaggtggaggccctgggcgccggcgccgatgattacatagtcaaacccttcgatccggtggagctgctcgccagagtacgcgcccatatcgggcgcacggaacggttcaaggcatcccggaccatggaaacgccgattgaatttgatggctataagatataccggagcgcctaccgggtcacaaaggatgacgaggaaatccgtttgtccaatacggaattccgccttttactttacctcgttgatcatgcgtttaatgcggtcagcaggaaacaaatcctggtcgatgtgtgggaaagcgatctttacgatgaaaatatcgtaaatacctacataaagcgtctccgcctgaagctgggcgtaggagaaggctatatcaaatcaatccggagcgtcggctatatgtttgaggcagagcttaaatagctctgcttccggccggaagttcaaaccagaatgtgctgccctctcccggaacggaataaaaacacatccgggaaccatgggcttccagaatctgttttgacacataaagtccaaggccgtagctctccttctgggtcggatcacctttataaaacatatcaaagatatactcctgctcctcttcgcagattcccgccccctgatccgatacctggaacaggaattttccgttttccaaggcgatccgtatcgtaaccgttgaatagggcgccgaatattttactgcgttgctcagcatattctgccatacacgaaggattttcacatcgctgatatacagctctccttccaccttctcaagacttccttcaaataaccggtctgaattctccacataagcctgcgcgttctgatagagagattcacagaacgtctctgcggataccggctccatctttatctgctcactgttctgcgcctcataggtgctgtccagaacatcgtaggaaatccgctccagcgtgtcggcgcttctgtagatttcctggataaacctctcctttgtctcctcatcctccacaagaccggataaaatccccttcgaatatcctttaatcagtgtcagcgaagtcctgatatcgtgggacagtgcagacaggaagcgggctgtcaggtaagatttcatctccagcgacgccgtcagcttcctggatttctgaatcagcgcgtgcgcctccttatcaaaattgttcgtctttatgttttcaattgtctcgctgatcgaattgcccaaaatctcgttcccgctctccgcgctgttaatatactgcgtgatgctgtcaatcggagaggaaattttatttgagaagtaaatactggcaaaaatagcacagccggaaatgattgtcccgaatatgataacggattttaaaagctgcagtgattttgcagccagctccctcttgggcatcagggtgtagagaatccagtcattctgatccatttttttataggaacagacgtattcacgatccacatgcttatagatttcccctgtatcctccccgctcatatcgctgaaaaaaggaagcacatcgacggccggtttcccgatctgctccggttcccggtgggacagaataaggccgtttgaatccacaatggaaaaatatccgctctctccaatcgcataattcttgataaatcccacaaatttttccgcccggatggcaataccgaacagccccagcatctggccgttctcgtcaaatatgggatgagtcgtattgacaatgcttgcctgatccgtcagagcaatcagaatatcacttgtctctgtcgtgcttttcttaaaactgtcctggacatatttcctgctcgaaagatccacatacatggcatttggcatggttgatgatataattaccccgtccattcccagacaaaacaagtctttataataatagctctccgactcccggttcatagcctccattgtatccgtcaggaaacggttcagctcatccgtacccagttctcctttaaagaaattccgcacccgctgttctctggaaagcgccagggtttccagccttatcttatcgacctgaagctctatcttttcctgcgccctcagaatctgaacctcggtaaaggtattggaatcctcactgaggattgaagccgacatggcgtagagagatgtacacattacgaccagagacaaggtaacgataacgcagatattaaacgtgattttatttttcaggttcattttcatagaagtaataccctttttccttttattcttataaatcattccttaattccagctcaattttatcatacttttaacaatcttactacctttcgcccaatttaggcggtaaaatcagtagttttatgtatatttcatataaaataatgacattctcatggatgttagctgttaatattgtgtaaaagcttatttgtttttttatttctgttatactttattcacatgatacgtatcaaatgaaattttaagcaaaggggaacaagatatggaaaagaatatgacagataatgcaagaagcagttcgaatgtattgaaattcatcctgttgaacctgattggcatttttatgttttttgttaccatcagcgtaggcggaaaaagttcaattcccattgaccatattgtaacaggactccgctcgattccttattttgaagtagtttatgcgggcctgatcgttgtcgtgggcgccattcttccgtttgtccggaaaacctggaacaaggatgccgtaacaactattttctcaatcttcaaagtaatcggtatcggagtcgtcggaatggccatcttcggctgggggccggaaagcttccacaccccggatatgctgcctttcgtatttaataaagtggtaatcccggtcacgattcttgtaccggtaggggccgtattcctgtccttcctgattaactacggactcatggaatttatcggtgtatttatgaaaccggttatgagaccaatctggaagacaccgggacgttctgccgtcgatgcggttgcctccttcgtgggaagctactccgtgggactgctgattacaaaccgtgtatacaaggaaggcttttattccgaaaaagaggccagcattattgccaccggcttctccaccgtatccgccacctttatgatcgtcgtagcaaagacacttggtcttatggatcactggaacctgtatttctggaccacgctgattatcacctttgttgttacagccattaccacacgaatctatccgctgtgcaaaaaatctgataagggatataacaacatggaagtaactccagaaccgaaagtagaaaaaggcaagcttgtttccaccgcctttgacgaggggttacatgcctgctcacgcgctcctaaatttgtggacggtcttgtcaaaaactttgtggacggcctgaacatggctcttaacatcggtcctaccctgatggcaatcggtttcctcggacttgtacttgcagccttcacaccggtatttgacattctgggatatcttttcctcccgttcaccatgcttttgggctttggctccgaagcagctatggttgcaaagggctgtgcaatcagccttgcagagatgttcctgccggccaatatcgtagccacagctactccggccacacaggcaatcattgcaatcgtatgtgtttctgagattctgttcttctcggcatctattccgtgtatcctcggaacggatatcaagctcagcctgaaggatatactgatcatctggtttgagagggttgtactttcacttattttggcagctccggtcgtacacctgcttttttaaggtgtatataccggcaaacggcgcaggactcaaaatcctgcgccgtttctacttttattttaatgctgcgtttgagtacccgccttcagaatcccctttaattcaaatcctttatcttccacggcttctctaaaaagggcatcctccacattttctctcatcaccacctttgccgttcccttttcaaggttaacatcggcaaagacaactccgtttattccggccagggcgctctccacggactgtttgcaagcgccacagtgcattccttcaatctgaagcgttttggagagggtgtccgtacctgccggtttcccggcagccataaacggctccacactgcctccggcgctgcaggaagagcttcctcccgaacagccggaacaaccgcagcagccgcctcccttgccgccgtaatgcctcagagtggagcggagtgccagaagcagcagagccgctaccactgttaagatgataatatcaattgtatgcataccgcatcctcttttctggtatctgtaccgataccgttcatattcgtcagtttcgtttctttgcatgacgggtaaccgtcttttttattatatcatatactttatagattatcactccggcaaaatataaaatcaggaagccgcttccaccgagcttcttgcataagacttctgagccctgtacggatccggcctgaacagcataaagagcataaatgccagacagattaatgcaataacggtccacacgttaaacgctacaacgccggctgccagaccgcccagctgataaatgcacagggcaacgacataggcaaagatgttctggtaaagaatggcaaaccagaaccatttcctggactggaactgctgcgccatcgtggcaatcgccgccaggcacggtgaatccagaaggttaaataccaggaaggagaaggctgcaaccgcggacgggaaccatgactggatagctgccgcaactgcatccggatcctcggaaagttcctccgatacattggccagaactcccatcgtacttacgattgcttcttttgccgtaaagccggaaatcgaagccgccaccggctgccactcgccaaagccgagcggacggaacacaattgcaatcgctccgccaattacggagagaagagaagcggaggactcttccacaatgccgaaagccccgttctcaaagccaaaggttgataacgcccacattactacacaagccaggaacagaatggttcccgctttgatgataaatcctttcagacgctcccagacatggagaagcaccgtctttgcggaaggaatatggtaagccggaagctccattacaaaaggagccggtttgccggaaaatggttttgtcttctttaacatgatagccgagacaagtactgctccaattccgaggaagtacatgagaggcgccatcataccgccgatagccgcgctgcctgtcatatggccggccataacgcctcccatcagggcaataaccggaagttttgcgccgcagggtacaaaggtagccgtcataatggtaagacgcctgtcgttatcctgctcaatcgtcttagatgccataatgcccggaattccgcagccggatgaaatcagcagcgggataaagctcttgccggaaagtccgaaatggcggaatacgcgatccattacaaatgcgatacgcaccatgtagccgcagtcttccaaaatggacaggaagaggaacaggatcgccatctgtggaacaaatccgagaacagctccgacgccgcctataattccgtccacaacgaggctggtcatcagtaccgatgcaccggccgtttcaagcagccctccggcccatccctggacagcggctacaaaggtgtcattggtccagtcagtcacaagagttcccagtgttgttacggaaacatagtaaacaccccacataacaaggacaaaaatcgggattcccagaatcctgtttgtgacaatgctgtcaatcctgtctgaaacactcattttagccgccggtttcttaaccgtcgtttcaatcagcttctgaatatactggtatctctgatccgtgatgacggattcagcgtcatcgtcatattctttttcaagttcaccggcatatttagaataccggtttccggctgccagcccaaactgttccagaactttactatcctgttccagcagcttgatggcataccaccttttttcaccttccggcacgcctgcgggaagttcggattcaatctgttccactctcgactcaacccagttgtcaaagatgggacgaagttcaggttcctgcgccttctttgccgcgccgaccgcctcttccaccacttccttaaggcccgtcttcctgagagcggacgtctcaacaatcgggcagcccagcttctttgataatgcctccacatcaatcctgatgtcatttttcctcatcagatcagccatattgagggcaagcaccaccggaattccggtttcaagaagctgtgtcgtcagatacaggtttctttcaatattagtcgcatccaccagatcgataataacgtccggtttctcatttaaaataaagtccctggaaacaacctcctccagtgtgtatggagaaagggaatagatccccggaagatcggtgatattcacttcctctcccgtcttactctctttcagtttccctgtcttcttctcaaccgttactcccggccagtttccaacatactgatttgctcccgtaagtgcgttaaacatagttgttttaccgcagtttgggttgcctgccaatgcaatatgtattgccattttttcatcctcctgccattctcacatttatttagtaaccgttcagacagcatgaactgttactttatttacctgacaatattagttattctaagctaaccattcattaaaattttatgctgccgtgtctcaggcgcttatttcctcaatatccacacagtcagcatcatcctttcgcagagaaagctcatatcccctgatggttacttcaaccggatctcctaaaggcgccacttttctcacataaatctcgcttcccttcgtgatgcccatatccataatacgccgtttataggccccctccccgtgaatcttgactacttttacagtggaacccacttttgcttctttcagtgtcattatgatactccttcccgtcaatcttccattatctcttttatatcaactattaatcgcatccgacatacgaatcataccaggatgtgtctggcctgctctttattgattgccactctggattctttcacatggacgataacgtcaccattaagctgtgtaatcagcttcacagaagtgccttcattaaatcccattgaatgaagatgggaacgcacgtcggaatttccgctcactttctttattgtgtaggacgaacctaccatacccattgagattggcatatttacctccctttccatatcatcaccttttcacgcatgacattaggacacacaaaccaaaattagttctttctaacccacaaataaggttagcacatactaactttattgtcaatgtttttttgattattttttccaattactcccaatatcaaacgaagtaccatggccatctatagattctttggttccgccgcctctccattctcttgtatgtgatgatttaacataaaaaatcccccttaagtagattttggttatttaccttgtcttcttaaggggaatcatatcatgattatcactgcgttttcttctgttcttcatattttgcaatcagacttacatttgccgcttcaaactcgttaaaaacaccggaatcaaactcaccggccggaatctttccctcataccagtcgcgtttgctgaaatattcggcaaactcctgcgttctgaactgatatccatgcctggcaaaaatctcatttttggcaatgcgcagactctcctgtgtcaggttccacaggtcttcttcttttaaataaatatagctgctgtttggaaatatgtactggtcgccgtcgtacccggcattcccctccttcacgcggaatgttttcctgattgcttcaatggaggctgccatgtccgaatactcggccctcaccgcctcatcttccgtgtaaaagcagacgtccgtaggctccgacattacataaacagtttccttgtcataagcccatatatggtaatccggtaagtttacataactcccatcccgatacgctgcaattccaaacagcagcccgtcacccattttttcataagatgctttttgctgtaccaacacataggggggagttccatccttatcctcaatcctgtattttccctgccatccggccggaaattcgaagatgtaatctttcgtctcaacccgttcaaagcgctcctgctccccgtcggagtgttcctccaacccggccgtttgcgacatctctggaaatgttgtctcagatccttgtactatcttctggctctgcgttgtctcaggcggtctttccggttctcccgcatcttccgtcaccgtactttccgggctgcttacttttcccgtactctgcacgtttgcttctccttttccggagcagccggccagcagtaaggcgcagaaggcgcccagcagcactgcttttgcatatctcatactaatctccttctgcttataataattgaacagccgtcaactgtcctgtttacagatttcaaatgcctcatactccttgtcaaaatggtatcccagcttcagggccagggccagtgatgccttgttgtgtgcgtcccaggcgggatacagccctctgtccagacattccagaatcagcctggcggcgcatgccctggcaagtccccggcggcggtgttcctcctttgtatcgatctcgatttcaataccgccctgataaaccgtgtaggaagaagctccggcagccagcgtaccgtcaaagagcacagccgttccgattccccgctccctgtaatcggcaaacgtcggaaactgcgaacagagatcagacgaccactcctcttttcctgccatatggtatatcctctcgtctatcattctgatttcatatccggccggcagtatccgcgacatcttcattaacttttcacggtcaaatatatcatactcttttttcagcgcgtagcgcacaataggttttgccgcgtctttgtaaacctgtctaatcaccgacgaccactgcccgttctgggggaccataattgtaaaacggcccttttcctctatccacctggcggccagctcccggcacggcgcgcccgcgaaaaagcagaagtcggcaatgaacagcatggcggaactcggatggacagtcgagtccgcccacgcactgcccatttcaccctgtagaaccgaccggatcatggtctcctcccagccttcaaacagcggtaccagctttattagattcttgtccgttattttatatatctccatctcttccatcctctgtcaagtcatccgtatttttatattgtttttctgtcttacgtcttttgtcaggcaatacgttttcgtttgaacaaagaggcgcccctctctgagcctcccatctggacaaatattccgcccatgatcagcagcagtccgataactgaataccgatcaaccggctcgttcaggagcagtgccgaatacaataccgccatgaacggcgtaatatatgcaaagttggaaagtttggctgtatccccattctggagcgccagggcccacatcaaaaatgctgccgcatccataaagactcccagccatataattccggcggtctgcgccccggtcaaagcgatggattctccctccgccagaaaccaaatccccgaaaacagagcggctgagaaaaaatagaccgtcatactgacaaactgatccctgttttcctttttgttcagcacattaaaagctccgtaacagacagccgccgccacgcagcttacaattccccgcagattccccgacaaaagcccttccatgctgcccttcgacgccaccagaaccacgcccgaaaatgaagcgaaaatcgccatactcttgcgccaggtaaacctctctcccagccataagcatgaaaacaccacagtcatcacaggccaaaggtaattaatgatacaggcatcgccggccgccagcccggacagtccgtaaaaatacagaaccgaatagagaaatttccccataaatccaagcgcaatcattttcacataatcttttggcctatattgcagaaaccgttttaaatttccgcatgccaggttcaggacggccataaaaataaaggcaatcatcgaactgataaatacggtttttgcattgcttaacccactcagcaatagcttggtaaacggcggcatcatcccccacagcatgattgtccccccggccagaatatattcttttttcatccccatgtctccctgtcgttatcatatatttttcaaccagtagttcactgttatcacagtatagtacaggggcttccggcaaactgtaatctatgttacaattatacaggatatgtaattcaataccggttttgaaaggagacatccatgataaaagtgcctgaatccctgttctgttactttgaacaagcggggattacgcgaaccattccccccggggggcttatctacatgcagggcgaaccgtccgggaccatctatctgatcaaaaaaggccgcgtccgcatttattatatagccgacgacggcagggaagtgacgctggcagtcgccggagcaggacggctgataggggactcctctttcctggcgcagtcctcgcgtcccacaaccgtcagcgccgtaccggaagtacaacttatctcctgtacgacgaaaagccttatgccatacctgatgcagtcggaagaactgtgcctcatcctctttcagcttctcaccgacacctgcaactacctctgcagccaggtaagacgcctgacactctataaccggcaccaaaaggttgccagcttcctcctcgacgagactgagacgccaaatcccgacaaggggattattggctctaccctcccctattcgcatgaagaactggcgatctgcgtcggactgagccgggtaactgtgacaaagatcctgaatgaattttgcgacgccggttatatagagcttggataccggaaaataacagtcaccggccgggcgggcctcgaaagcctgtttacctgaccggtgtccaacagtctgttattttaaggagattgcaagccccacaccgacctcctcgaccggaagcgtttcattcattctcgccttcgccctgaatgagacgcagtgacagggatagaaggattttataccgagcttcgccaggtattccaccgtcttctccaggcggctgtctgtctcaaaaaggtgaaaaccgcccaatataccggcaatgcgcctctcgccgcagacctccatcgcatattccgcgatattgcagattccgctgtgggaacagccggtcacgatgaacagcccctcttgcgtcttgagcgccaaggccgaatcatccatcacataatcgcgttcccatttactccgtatcttctgtgttccgatggaactcctgatttcaaaatcattgcgcgccggaatctcacctaaaaatatacacttatcacttatccggtacggcatcccggagggtctgtatctccctgcttttttcaccttatcttcccgaagcggtgagcctatctccaggccgctgtcatcaagcttcggattaaagcactccggatgggcgataatctccaccttctttaagtcagcttgtttttccagccagtaaaatcctcttgtatgatcattgtgtccgtgagagaagacgaggtgcgttatctcctcaagcgggattcccatctgcccggcattcgttataaatgcctgggaatatcccgtgtcaaagagaatccggcagccgtccgcttctatataataactcaccgccggctctcccagataatactgatcgatatatgtattgttatccattagaaccctgatttctatctcatccacctcatcccactattatttctgctgttccagccaatttatctttgccagaagcctgctgtcgtccggggaaaaagtacgctcatcgtaactgttgagaaagtaaataacgatatctgtccctctcagcccgacaatctctttccctgtctgagtaagataatacttcatttcaccgcccgtgtccagcagaatgctgccgtccagggaaatctctttctgagccagatagcggtccagatatttttcatttctcagttcggctctcacggttccgatatatctcagtctttttgcatattccggcgttcggctgttaaccggtgctgctgcttttccctcattgtaaatgatgagctccgatttacaggcgagattggacggttcgatataaaagctgtgttctgtcgttccccagcccagatcagcgggactcatccccaggagaaaaacaggattttttaccgacggctcttcataattccactctgagtctttggtctggaaacggtaatcatttttatacggatacaggtaaaaggcggctataatcagaagggccgggaggagaaccgcgctccgcttcagtcctctgtatctgacgacgccttttctgtaatccctgtataaaaataccagaatcaacagggcgctcagaaccgccaggactgaaagcaggctggacacctgcgccagttccctcaccccgcatatcagcattggaacggcaaacggcagacagcctgcggcattcagcgcaggctcgtcccaaaacaggataaagtcagggatacttcccgtctcttctttatagcgcagcgccctcctctgtcttaatttaatactcaggcctgcagtaagccaaatccagtaaagtaaaagtgaaaaaaacaggcaggccaggttttcccatatgccgaaatatttactgattcccggtgatcttaaacgaaaaatcaggaaatagggaatcgcaagcagcaaattaaatgcagccatggtgagcagcgccttattttcctctttcaccgtcacttcataaggcccatccggacggcagggggaatataccgtatagggcacaggcggacggacgtcccctttactgtaaaaagtaacaagatttttcagcggagcattatattcccagccgttttcttcccatcgctgccggaactccagaaaacgctccgaacgctccacctccttcgtcacctctctgtcaaatatgccgatcgaaaattgatacttccccatcatcacctgctgaaagcttcctctgccgtaaccaaaacaaagattcttaatcagatggccctccgccgccttctgttcgaaaaaacgttccagccgttctgtctcaaccaggctgtacggtatcggatatgtatcgtattctttcaccaatcccatgcaaagacctcccttccgcctgcggggcaatgaaacttctgcccctggcagataaactgtccgctgatttcctaatattattttatcacatcaggaaaatggaaagtccttacaatatttgatgttttcttacattttcttcacttacctattcttccgccgccgatacctccggcgccgccacgctttgctttacggacattttttctgccgtacaataacagagaacggcaacgataatgcatacaatcggggtcggaacgatatcaccgaaggaggtaaaccagcccagtcccaccggttttgcagtcattgtaattcccacaaaagaggcaatagcccatgaagccagagcgccgtatttacatccctccacgccgccgtcgccctctttgtcatagctctttctgttgcacagatagaaatcggcaatcaggatacccgtgattggcgcgatgaatacaccaagcaggcttaaaaagttcacaaagtatttatacacgccgagtccggcaatcattgtgctgataatgccgacaataaaggtcagcttcatgcgggagattttcaccacaccgtccagtgtattcatcagtcccagtacactcgtatacaggttgttgtcattggtggtccactggccgataatcaggacgacggctccgaaaaagccaagtcccagggactctatcattatctccacaatattccagttgtggaaagcatagttaaagaatgctccgcacatcagtaccgggatatagccccagaaatggccgatgctgactccgatggcacagtccttcttcgtggtagaaaaacggctgaaatcgcctatcatcgcaatccccaccgcaaagcttcccaccacgatagagattcccatcggaattgtgatcggttctcctacaggcccggcctccaatatactgctcatcggaatgataccggctgttttccacactgccacgatacacaggacgaataaaagcggaagtccgatctcgctgagttttttaatagctttaaaacccataatggcggtgagcgacatggccagtccgccgataatcgtaaaaataacgggattgatcgcagttcccctcacttctcttataatagaggaaaccgtattgccgaacagatccgcctggaatgcgtaccagccaaagttggaaaagcacaggataatgccgattatcttcgctccctggcgtccgaacggccttctggctgtaaatgacgtggataaatggagatgcgtactcacgatggcattcagcatcccaagaagcgtgataattaacgacccaagcacactgaccagcagcatctctttaaacgacaggccgttggcaagaaggccgcccgtcgccaggccgctcaggccgaagccggagccgagccagaccatgccctgctcaaaccaggtctgcctggctttcggaggcaccggagttttttcatagtcattgaatatctctgataacgaattttcccgattcttttcacccatctgcatttcatccctcctggccgtccaaaaaacggcattccatgtcaaagccaaagaattccggattcagaatctcaagcccccgcttcgtcctccacagctcatgacacttaaatcccagtacacaaagctccattccctccgtacagttggggtttgtcacaggcatgccggtctttctctccactatgcagatcaaatccggacaggtcagcttcacctcttcatctatccagaatatcatattttcattcttataccaaactcttccgaccgagtttttataatcaccactgccctgaagaaagatgtttcccagcgtaaagccgtccttgatttcccagttcgtatcacctgtcacattcccttcaaacagcagtcttccctctgcggccttaaggattgcagatatgggatctctcccctccgcacaggcctgtcttctggcttttcccacctgctccgcataggtgagcgccgacgggacaaccgccttttttaagttccttccctggattggatgatccgccattcccaccaggttgtcggagccaactgccataaaacgcgataaagcctccgcgcgggcatcgctgtcaacctttttaacaatcaccacatcgccgtactgtgtagttacggaaaaaggcgtgatcggctgttccatcacatagtaggtagaaaactgaagctccgggacagcccgccccgccgcgtccgcgtccaccatatattttccaagatgtgcggccgcagccatcgcctcgccggtattgcctccgccgtattcaatagaaacaagtccgtcaaaggcgacgcccatatgctcctcgagcgcccttacggccgacggaatttcctcccctgtaatctgaacctcctgtccttccggcatgatggaaccgcagaaataaggattggtaaaccaggcctcatcctgaatctcatgaaactccagcagtttaaactcttttccctccccaaattctttttcaacagccgcaagcccgctctgaagcgaaccgccccctcctgtcccaaggattgtgcatcctgtcagtatatcgctgacctcctggtaatccagccttctcatgattttctcctccttcttttaatctaaccccttatcctatatcaaagccacaggtatccgttttcccgaaaaacaactactgcccaacagttagccggatagtgtaattatatcagtcgtcctttatcgcttcattatagtacagtacaaaataaaccggactatcattgtaataattacaataccgcgcagaaatccggctctaatttccgtcggagataccatgttccctgtggaacatggtataatggctgcaaagcggtcattataccgcgcataaactgccgaaaccggggagggatttcaatgaatattacggtccgtgacattatggaattaaatcttttaagagactctgaaattatatcgggaaaaaatggattagacagggaagtaacaagagtaaattttacagactgccccattcagttcaatgatttggagtacactctggcactgaaaggtgatctttacatcagaagtctgtactgggtgaaggatgacgaaaaagaattatatgacactttttatttctacgtaacaagcggaagctcctgctgtctcgttacgaatgaatatctgccggaacttccaaaacatattctggaattgacggataagcataattatcctgttatcaagattgacagcaatgttccttacggtgatttaatccgtgatatatcagaattactgatgaccgagcagtcggagctgttctttgaaaataaactgaaccgccttctctatgagacgctctccacttctgaaatactggaaatcggaaaatatattaaccctcttttcaaaaaagagtatatcactatctgtctgaacctgccgggacttgataaccgtcaattctacagcctgcaatctgatttgaaggtacagtaccagctccgcctgcggcgttaccagaacggcggttttatcattttcaactatcaggagcgggctgaatttgacgcagcgatccccggactcagaaagctgttccattattattgcaacacctactcgtcaggcatcagcggagcatttgaaaacgctgccgactttcagcagagtatccgccaggcctgctcctccctcaggatcggcattatgctgaaacagcagtggacttatcctgacgatctgcacatctataatctgctgatggccgtccacgataacgctgctcttaaaaacttttatacaatgactctggcgcccctgatccagtacgaaaaacggtacagcgttgatttgattaagacgatagaaacttatctcacctgtgacggtgattataaaaaaacggctatcctgctcaaacagcatgaaaatacaatccgtttccggattaacaaggcaaaaagcctgctgggcatggagaatagccattataaattcattgagcaggtgtctctggccctgaaggcgcgcagtgttgagaaattctcggtgaacaggccgcccaacggactctgacgaactgtaatataacagtcatgcagcacggacttattatcgctcatcggcacacagaaaaacccggaaaacaaaaagttttccgggttatcttacgcttggacacaatgtaccctgagggtactatataaatttactccgcagcatctccctgtccgcgaagcggatacggagacactcatggattatagtcgattactcgatgatagaaactactctacctgaacctactgtacgtccgccttcacggatagcgaaacgaagtccctgctccatagctactggatggatcagttcaactgtcatctcgatgttgtcgccaggcatacacatctctacgccttctggtaaatcacaaacgcctgtaacgtctgttgttctgaagtagaactgtggacgatagttgttgaagaatggtgtatgacggccaccctcgtcttttgtcagaacgtaaacctgagctgtaaatttcttatggcattttacagaacctggtttaacgagacactgacctctctggatctctgttctctgaacaccacgaagaagagcaccgatgttatcaccagcctgagcctcatcaaggagtttacggaacatctcgataccagttacaactactttacgaacctcttcagagataccgatgatttcaacttcatcagatacatgaagtgtaccacgctctacacggcctgtagcaactgtaccacggcctgtgatggagaatacgtcctctacaggcataaggaaaggtttgtctgtctcacgaactgggtccggaacatagctgtcaactgcagccataagttcaagaactttgtcgccccactcgctcttaggatcttcaagagcttttaatgcggaaccctggataactggtgtgtcatcgcccgggaattcgtactctgtaagaagctcacggatttccatctctactaattcaagaagctccggatcatcaaccatatcacacttgttcatgaatactacgatgtaaggtacgcctacctgacgggaaagaaggatatgctctcttgtctgagccataacaccatctgtagcagctactacaagaatagcgccgtccatctgtgcagcaccagtgatcatgttctttacatagtcagcatggcctgggcagtcaacgtgtgcgtagtgtctgttctctgtctcatactcaacgtgagctgtagaaattgtgattccacgctctctctcttctggagctttatcaatgttctcgaatgcaacagcctcaccagtacctaatctctcatgaagagtttttgtgatagcagctgttaatgttgttttaccatggtcaacgtgtccgatggtaccaatgttacaatgcggtttgtttctttcaaactttgcttttgccattttataacgtcctccttaatttgcgcccatcagggggcttcataatttatgttaggctgtctctaattatattctatcagagcatgtttttcaagcctattatttactttccgggcagtttttgcactgcctggaaagtttaaaacgatttgttttcaattacttttctgcttttgtagcaagcactttttcctgaacactcttcggaacctgctcgtatttctcaaagaacatggagtagttaccgcgtccctgtgtcttggaacgtaagtctgtggagtagccgaacatctcggataacggaacgtaagctcttacaagctttccgccgccgatatcttccataccttcgatacggccacgacgggagttgatatcaccgataacatcacccatataatcttccggcattgttacttctaccttcatgattggctctacaagaatagcgcctgctttgtgcatagcctctttgaaagccatggaaccagcgatgtggaacgccatctcagaggagtcaacctcatggtaggaaccgtcgtatacggtagctttaacgcccagtaccgggaatccgccaaggatacctgctttggtagcctctttgataccttcgcctactgccgggatatattccttcggaatagcgccgccgacaacagtggattcgaacttgaatgtctcttcaccgttggcatccattggctcaaagtgtaccttacagtgtccgtactgaccacgtccgccggactgttttgcatacttgctgtctacgtctactgcctttgtaaatgtctccttgtatgctacctgaggagcgcctacgttagcttccacgtggaactcgcgaagcagacggtcaacgatgatttcaagatggagctcgcccatacctgcgataatcgtctgtcctgtctctttgtctgtgtaagcacggaaagtaggatcttcctctgcaagttttgcaagggcctcgcccatcttatcctgtcctgcttttgtcttcggctcaatagcgatatcgataaccggctccgggaataccatggattccaggattacagggtgctgatcgtcacagattgtatcacctgtcgtggagaacttgaatccgatagctgcagcgatatcgccggagtaaactttgtctaattcctgacgtttgttcgcatgcatctgcaggatacgtcccacacgctcttttttaccttttgttgcattcagtacgtaggaaccggagttgatgcttcctgaatatacacggaagtatgccagcttacctacgaacgggtccgtcataatcttgaatacgagtgcggagaacgggtcttcatcggaagaatgtctcacaacttcgttgccatccggatcagtaccctcaattgcagggatatctaacggggaaggcataaactcgataactgcatcaagtaatttctgaacgcccttatttctgtaagccgtaccacagcaaaccgggatagcctggcattcgcaggtagcttttctcaatgctttcttaagctcatctacgcttggttcttcaccttccagatactgcatcattaattcatcgtcaagctcgcagattttctctaccagctctgtacggtacagttctgcgtcatcctgcatgtcttccgggatatcggtaacggagatatcttcgcccttgtcatcgttgtagatgtaggctttcatctcgaacaggtcgatgattcctttaaactcatcttccttaccaatcggaagctgtaagcaaatggcgttcttgccaagtcttgtcttaatctgctctacggttccatagaagttagcgcccaggatatccatcttgttgatgaatgccatacgtggtacgttgtaggtgtcagcctgacgccatacgttctcggactgaggttccacaccacccttagcacagaacacgccgaccgcaccatccagtacacgcagggaacgctcaacctctacagtaaagtcaacgtgtcctggagtatcaataatgttaatacgatgctccagtgcgcctggtttcggtttacactgttcctgcagagtccagtggcaggtcgtagcagctgaagtaattgtgatacctctctcctgctcctgagccatccagtccatggtagccgtaccttcatgagtatcaccaatcttatagtttacaccggtgtaatacagaatacgctccgtggttgttgtcttaccggcatcaatatgagccatgataccaatatttctggttctctctaacggatattctcttccagccaaagctttttcctcctattagaatctgtaatgagcaaatgccttattagcctctgccatcttatgcatgtcttctttcttcttcacggctgcacctgtattgttggatgcatccagaagctctttagcaagtctttcttcctgtgtcttctcgcctctcttacgggagtaaagagtgatccagcgaagagcgagagcctgtcttctctccggcttaacctcgatcggaacctgatatgtggcaccgccgatacgttttgccttaacttccagaacaggcatgatgttgttcatagcctcttcgaatacttctacagcgtctttgcctgtctcagctgcgatacggtcaaatgcaccgtatacaattttctgggcaacaccctttttaccgtctaacatgatgttgttaatcagcttggtaacaaccttgttattgtaaagcggatctgctaatacgtctcttttctgagtatgtcctttacgtggcacgttacttccctccttaatatctgctccagctccggaaattgggccgaagcttctcattagatcttaggtactcgcattaaatgcttagtgatgcttcctcactcatagaatgcgttcgcgctcggttctatgattacctgcaacctacagggtcaatatcaaagtccggcacaacaattcaaatgaattctacctaaatttcgttttaattactttttgtctttcggtctcttagcgccgtatttggaacgggcctgtcttctgttagcaacgcctgctgtatcaagagtacctctgatgatgtggtatcttgtacctggtaagtctttaacacggccgccacggatcagaacaacgctatgctcctgtaagttatgtccctcacctgggatgtagcttgttacttcgattccgttggaaagacgtactctggcgatctttctcagagctgagttaggtttctttggtgtagcagtcttaacggctgtacacacacctctcttctgtggtgcagaaatgttggtagctctcttctgtaaagagttgtatcctttctgcagagccggtgctgtagatttcttctcagatgtctgtcttccttttcttactaactggttgaatgttggcatccttttcacctcctgtgatattgtctgtggttgctttttaagctcttatttttacgcacaaaaatacactcgcatttttacacgcctacttattatatacagtttgtcaatttgtgtcaaggcataaaatgtaaaaaaaaactgctttttcggcgtatttatggtgttttttcagatatgcccgcgtggattgcgggtgaagcggcgtaagcagcctcctctttccggataagcccatcaaaacagctacatggattcttcccaatattatgcagaatcattcatttaaaccggattttaagtatgaaaccaaaaagcagttaccatctctgtcccgccgcttccctctgacaggaactccctggcaggaagttatgatgataactgcctttttcgtttttaaccattatatttttatcatcttctgccattcttccggcggcttttatctcccgaaaggttactttttccgcaacagttcagccatgatgtattccgcgaggtgttttgctgttttttgcgaaaatcccgagttgtgcggcgcgaaacggcgttttttttgccgtttctgtgcatcatttgttacggtttagccgaaggctgaactgtaacttttttcctggcggccagaaaatagttgacggggcgttcaaacagcgcctcccgctccattatctcaaatcccccgttctcaatcatctgttccagactctccggcgtgtaaaactctacaaagggcatctttccggtgcggcttctataccatttacgcaaagcttcctttgtaaagctgtgtttcaggcagtcggctgccacaaaaatgtaaccgcccggctttacaagctcctgcagtcgcttcattgccgcagcctgatccggcatatataaaagcacattaaaaatcataaccgcatcgtacgtacccggctttagttcttccataaacatatcgccctggatgaaatcgatattaccggcttcggccttctttgctttttccctcgcctggcggagcatctccggcgcggtatccaccgccgtcatctccgctacgctgccggccagttctatcgtagtcacaccggtcccgcagccgatatcaagagccttgtcgctgtccttcaagtatttcttggtgtaatcaattgttttcctgtaggcttcctcatatgtcgttaaaatctgagtatcgaatatctccgatcgcttattccagtatgcctcgttttctgaataattttcctgctcctgcttcattttgtttgccctccccatttgcttcctgtttttaccggatgaattaaaacgggtcaatcgtcacgttttttttctgaaagaagagagattcccgcacatgcaaggccgagtcccagcataaagaagcccgaatacatgtctatcgccttcataaccgacaaaaccgccacagcaattcccattgccagagaaagagctttgaagacgatcgggataatccggttagcaaccggtctgtcgttcaccggcccgtcattcgtcttaatctgcatcagctgatccaccgatatcccaaatattcccgccagttttggcagtgaattgacatccggatatgacaaatcccgttcccactttgaaacggccttatccgtaacccccattttttcggccagctccaattgtgtcattcccttttcttttctatattccgcaatcagcattccaaatgtccggttcctcataaaatcatcctccatttattttgatgactgcatcgtaacattttcccgtgaaccattcaaccgaccggcagtttagtccggtagacctgcggtttacctcccccttcggttcaaaacagttttcttctattctaatatctgcccgggaatatgtcaaatctccctgttcccggtctgctgtgccagcttcatatataaaagcggataaggattcccctgttcatccgtctccgttcttttatataccctgaacccttcatgttcataaaagcctattgcctgcggattctgctcatttacacagacttcatcaatcccgtatcgtctgattccataccggagcatccggcttcccagacctttccccctctgctccggtagaataaacagcatctccagcttactgccgccgattcccatgaatgccgccggaaagccatccggggccgccgcgaccagcagatgcgggatctcttttaatgcctccggtacgtataccgcaatttgttccacctcttcgtcggacaggaataaatgggttgccttcaccgactttctccatacctgagtcagacggtttatcagtgcctcatcccgaacatcggcagcaaagatttctgtcttcccgctgtcactctgttcctccaaaaccttttttggccgctcctgcccgatatcctccggccttatcttttccataacctcatagaccagtatcacgccgttttcaacctcccatttatcatgataagatgttttatatcccagcgtttcatataaatgacaagccggaagcgatgcatccagataaattctgccgtaatccgaaaaaatttcttcctccagcttctttattatatatgtgccatacccctttccctgaaaagacggagaaacgtagactcttgtgatatggtcaccttccctgctcccggttcctgctagacatccctccactaaaagcattcttatatttccgttcctgatgtcttttcggactgcatcttcacagtgcagtccggcaaaaaaatccaccacctctttcggatagtatttcggatataccgaagcaatcgtctcctgcaccagtttcgttatctgcggtgcaaactcttccgaagcatttttatattccagcatgttatttcatcccttttcttcctgtttctttattgattaggctctgaagtccactccgtcagcagtatatcgccgctgaaagcgcggctgtctccatttgatttgtgtaaataaacatcctcatccgggtaatagcaggtatcctctttttcaaccgtcccgatatccaaaatcaacataggctccgttccggagttatagaaagtatgggcaagcattctccctcccggtttggctataaaatctcctgccgacacttcctgctccctgtcattcagccgcagtgtcccgcttcccgacaatacgtaaaaaaactcttcctgctgggaatgactgtgatatttcgtgctgaacgccttgggaggaatactgtccagattcgcatatattttttcacttccggcatactttcccagttccttcgtcattaatcctgccttatccgaccagataaattctgccggaatttcatcaatattaccttttattttcatctactctccttgtttccatctgttcctgtttcctgatttaccgttgttacgtttcctgttttctcattggccgcttctgcatgctccggtatctataaataatccccctgcaatttcaactgcatttgatcacttaacggcacaaatcccagcttttcatacaggggacgccccatctgcgtggcgtcgagcaggagctttccaacacccagccggcccgcttccttaatcagcatccgtaccagtttttctgcatgcccgcgccttcggtacccctgcaccgtataaacattcagcagctcggcgcagactccggtcggacagctcgggagcggagccgtatggaaaatgcaggccatacaggaggaaatgattctatccccttcaactgcaataaaaataaccatatcatccttttccatatgttcttccacataatcccgcgtcctcttcctgaataattccagctcatcgatttgtctgatggaagcagcaaattccacccggttttcaacaaaacgctctatatcgcctcggtttgcacgcctgtattccataaaacacctcctgattcagcagcttctatttcaaccgccctctctccctcgggccaaatcatttataattccatatctgcccagtcaaccaaatcttctccaccggttcccttataaaaatcctgaaataaaacaatcgccgtatcgagagtcagaacctgcgccggccggactttgacgcttcgcccgccgatatataccgttccctccgtctgcgctgctccctgtgatacctcttcaccggtcctgtaccccgccttttggtgtatatgagaaaccggccccgtatatcttcggacctccaccgtaaaggcattcctgcagcctccgatttgaatataattacctatcctgtcttccagaaaaagatagcttctgttgctggctgtcattttttccagcttttctctcacctgcgcaaaatctgatacctccatgcgccggaaccactccccctccagataatgctcccgtacctcattgaaaaagcagggcctgctctctgcaccgaggtcaaaaaatccggcattggtaaaccaggccgttcttctgactatatcgcgcgcctgttctgccacggaataactgaaagacagatagattatatctcttccgacacagtaatcacaaagcctctcttccagcccacgctccttttccaggcgttcgctgtcaggggcggacgctccgttcatggggggaaatatatccttcaatatataaaagaattcctgcagcgcgggagatgatacagacggattatcatagccatgctcctccacctgctctgtctgctcccggtaccagctcaggaagtccttctccccctccggagccttacttttttcaaaaaccattaaatcataactcatccgcatccctccctgccttactcatcctgtaaaacctcaatcagattatcactgacacagcctgctgccaaagcagtctggcggacaaatacccccgcccgggtaaccgccgtctgtcatatcagctaattatcattttatagaattttgttcaaataagctacagctatctcaattatttactttacaattttgttaacatgcatatcataccatgaaaaatttatggtataatgaccgcatgacggttattatacccgcgcataaacggtttctgcgttcaccgcagatccggcacagcttatgaaaggttaaggcagcggctctggtatagcccctgccgcggtgagacaaccatgagatgcaaaacagaacgtattcaacaggatttggaatcactatccagatttaatttaactcccggcagcggctgcaccaggctttcctacacaaaagaattttccggcgcccgtgattatctcaagcagaggatggcggaggcggggctaaaggtgcatgaagatccggccggaaatatcatcggcaggtatcccgggaaggtggaaagaccggctgtcatgaccggcagccattttgacaccgttttccacggcggaaattttgacgggcaagccggagtttgcgctgctcttgaagctgcccgggtaatgagtgagaatcatatcaccccctattatcccattgatttcatcgccatgccggaggaggagggcacccggttcggaggcggactgttcggaagccgggccatctgctgcggcgtcaccccggatgagttaaaagaaataaaagacgccgataaaatcacattatatcaggcgctgaaggattacggcttaaatcccgatgagatagaaagcgcccggaaaaagccggaggatatcgccgcttttattgaactgcatattgaacagggccccgtccttgaacagaatcagaaagatatcggtatcgtcgatgcaattgtcagcctgaaatgctatgacgtcctggtcagaggacgggccgatcacgccggtacgacaccgatagatatgcgtgcagacgccctactggccgcggcaaaagcgattgcggcggcaaccggcagggcggccgcctgcggcgacgggacggtgattacctttggctgtatggattcctcaccgaaatccgccaatgtagttccgtcgcaggttaccttcaccgccgattgcagaagctccgacatccggtcaatccgaacggttatggaggccttccgtgaaacgctccgggaaagtacggaacactgccccgatttatcatttgaaattagcaggacattacaggcagaccctgccgccatggatatgcgtctgaaaaagataattgaagatgcggccgatgagctttcactgtcctcgatgcatctgttgtccggcgccggtcacgatacgatgaactttaaaaacatgtgtccgctggccatgatatttgttccaagcaaaggcggaagaagccactgcccggaagaatggactgattaccggcagatcagtgacggagccgacgttttactccgcacaatcataaaagctgccgcccatgaaatttgaaaggagatttaaaaatcatgaaacttgtcattatcgaaccgctgggagtagaacagggaaaactgctgtcaatggcgcaggaggcgcttccggaggatctggaaaccgtatactacgacacccgtgtaaccggaacaaaggagctgattgagcgcggaaaagatgccgacatcattgttgtctccaaccttcccatgaacagcgaagtaatcgagggctgcaaaaacctgaagcttctctccgttgccttcaccggcgtggatcacatcgccatggatacatgccggaaaaacggcgtaaccgtctgcaactgcgcaggatattccactgtcgccgtggctgacctcgtatttggcatgattatctccctgtacagaaatatcatcccctgcaatgcagccgtcagaaacgaagggacaaaagacggcctggttggttttgaactggagggcaaaaaattcggcattgtgggcaccggggccatcggactgcgcacggcaaagattgcccgggctttcgggtgtgaagtatacgcttacagcagaacggttaaggagatagaaggagttacctatgttcctctggatgagcttctctccgtctgcgatatcgtctccctccatacgcctctgaccccggagacaaagggactgattggaaaaaaagagctttcaatgatgaagaaaagcgccatcctcatcaatacggcccgcggccctgtggtggacagcgatgcgcttgcaaatgccctgaacagcggcgccatcgccggggccgccattgatgtattcgaaaccgaaccgccgattaaaaaggagcatccgctgctgaacgccaaaaatgtaatcgcaactccccatatcgcttttgccacaaaagaagcgcttgtaaaacgtgctgtgattgtatttgataatgtggctaaatgggctgcgggtgatgttcagaatgttatgaaatagataatggagatttaactgaggttggaggacgcgtccggaacggaccatgtccggtgtggtgagggggatggctgagtcttccgtccccggttgaaggtggtcgtgagggggaatccggccggaatgaattgctgcggggaccgtttgcactctttggagtgcgcaacagtgctaagctcgtgagggacctcgccaagcaccggcggactcccatgtcccctccgcaattgattccgcctacttccccgggtcaggttatcgcagggacggaagactcaggcggaagttttcgcgacaccggacatggtccgttccgggcgctgattgtctctaaccttaaatggggaggaccctgtcgagaccactacgtgtttccggcaggccgatatcaaatcttccacaattccttaataaaggtgcattgaaggcatatcgtatttcccgttcacggaagctcttagtggccgcgacaaggtccgcccccgcacttaacgcgtgagacaatcagcggccgcaggccggcggacggggctgatacacccggcggagtctttcgtcctgtcgaaaacctggccttggggcggaggggaagataaagtctgcggatgccgttgaaatccatcgctgattagcgaggtcctgtcgagcttagcagcgcgatgcatttcacagagcgggagcgtgctccgcagactttatcttcgcccgcagccccaaaccacaacaatcttcctccgagacgaaagactcatatacacaccccaccaccccgtccgctggccgtaccggcggcgtcctcacctgcttaactaaatctctttactattcctccaaaagactcatagcagcctccacaaaagtccctgccccgatatataataccgaatcgtccacacagtaccgtgcattatgagccggataatattccccgtcccgcgggtttgccatcgcagtctgaaggtagaaataacaccccggcgctttctggaagaaaaaggcacagtcctcccctcccatttccggtttgttaatcgaccgtacacgttctttccccgctatcttttttgccgcttttctcacatgctccgagaccgttgcgtcatttgaaagaggcggatagggctgatcaatcctgaatgtgtaatcagctctcatagcctttgccgtgtggtctataatctcctcgatccgtttcatgacaaaatttctggattccatatccacgtttcgcacggtgcctataaattccgcctcatcgggtataatattactggtcccgttccccgccctgacggttgcaatcgtgattacactggaattgaggggagacacctctctactgacaatatattgaaggttattgataatcagcacggccgccgcaatcggatcaatacactcgtcaggagcacatccatgtccgcctttccctttgaccgtcacatagatttgttcgtcggatgcagatacgtatttattgctgataataacggctccgttctgataaggctcctctgtctttctcgttgtatgcagggcaagcatatagtccactttcggattctccataaccccgtcctttaccattggttccgcgccgcccggccattcctctcctggctggaacaacagtctgaccgtcccgtttatctcactttcgtggcgttttaataattttgcggccgccagcaaaattgccgtatgggcatcgtggccgcaggcatgcatattcttattttccgagctgaattcaagacctgtgtcctcctcaatcggaagtccgtccatatcgccccttatggcgactgttttgccctgcccgttgccaaaatccgccacaataccggaatggcccgtatatgtcttatatgtaatacccatccggtcgagttgttccgtcacaaagcggaaggtttccggcaatatcagtccaacctccggaatccggtgaagactgcgtctccataaaatcagctcctcctttatctcaagagcttcactcaagatatctcttttcatttattatcactaccctttcttaatttcttaaatttacgccctgctgcttactaaaacggtccgtatccaacctttaccgcaaaaattaggaacgcaaaggttatcactacccacactgcgtaaagcggagtcaggaacttgatccatttcccccaggggaccttggccattgataaagctgccatcagagttgcacaggtaggggtgactacgtttgtaaatgaatctccgaactgaaatgccagaaccgccgtctgccttgtcactcccagcacatcggaaagcggggccataatcggcatcgtaaccgccgcctgaccggagccggagggtatcaggatgtttaaaatattctggacaacgaacataccgcaggcgctgagcgctgcaggcagcccctgcaaaagtcccgacataaagtggataaccgtatcaataatatttgtgctttgaagaatataagtcgccgcgccgcaaagtccgattgccattcccgcccacaaaaggtttccgcagcctttgataaattcatccgtcatctcacccggcttaagtcctcccacgattccggctaaaactccggcaatcagaaaaacagcggaaagctcgtcgatataaaagccaaactgagtaactccgactataagagccactacgctgcctactaaaatcaaaagcaccagcttatgccgtatcgtcagcttcggcacattataaacatcaatattaacaacatgggttttatcttcctcataaaccggactggactccggatttttacggacctttatcgcgtgcatcgttacataaacaatactaacggagaggaaggcaacaaaagcggctatcctcagccacatccccgaaaacaggggcagtcccgcaattccctgtgccactccgactgtaaaggcgttggtaaatccgccggaatagccgcaggccgccgccatccatacaatacccatggccgtcatcgagtcaaatcccatggcaaggcagacggtgaccattagtggaaagaaggccaggaattcttcaaagttccctgcgcaagccgagccgaggccgaataccaccatgcaaatcggcacaagcagaatctcttttcccgccattttcttaatcaggttcgccattcccacatgaagcgctcctgtcgcatccataattccaaatacccctccgatgattaagaggaagaaaataatatatccggaattttgcaatccaatcgtcaatgattcaaaaaactcaaaaaacccaataggcgtctggtcaatgtaatgtaaggtgtcaggattaaccagcattcgtcccgtagcaggatctgccactctgtcatacaaaccggccggaactacgtagctggcaattgcactggccagtacgataattaccaggatcagcattgcgttcggagccttcaactttaactttttctttttttcactcattaaaaaacctcctcctgtttattttgttaatttataataaaatctgccgtcttcctttatcccccctttgcccagatttcagctctccttttttcattcggtaatagaggacggaacatcccgctcctaatataaacacgattcccgaagaatagaacggcagcaagctgcctgctccgtatataaaaccggcaaataaagccccgaacacctttcccgcatactggcaggaattaaacataccggcgacactgccgctgttttccttattgctgtcctccgtcgccattgtctgctgaagaggcaggtacagcgcattaaccgcataaaatataaagttgccaaccacaaaagccgggacatccgatacaagcggaaccgttaccgccacgacgccgtttataaaaagacaggcgataatcgagcgcttgacctccgtcttcttcatcagccaggctcccactgtaaaatccacaatgagtgtaatgccccctatcccggcccgaatcaggccattgtaataattggggaatttaagcgcctccttgacataatagttatatgcgttgtcatacgcagtcgtggcaaagctggcacaaaatacggaggccatgaacacggccagcaataccgtaatatttgatccgctcttcttttggtccggcaagctcctttcctcccaggcagactccggatccttaacagtcaataaaagtatgagggcaaacaggaatatcgccacgacctgaatctggaaagccagttcaatagatatgctgcccaaaaaacctcctatcgaatatccaaccgcacagcccgccgttgacaaaaccgaatagtaaagcataccccggctccgttcctcggctccggtaagattgatcaggccggccagtgtggctaccggaacggcagaacaggtaattccgccggccagacggcatatgatgatctctgcctgcgtaaccgaatagtaaaacgcaatctgtgtaactgcataagtgacaaatccaataaaaatcactttcgtacagccgattttcccgcacagccttccccaaacgggagccataaaaaaggaggccccggccattgccgcaaaactcaccccaaacatataatcgggaaggcccagttccagaaacatcgccggtgttatgggattaatgagattagaaaaagcccagaaaaacgcatgaaaaaataataaacgctttgcatcagcctttttcatgcctttaattcgatccaacaccactctccccctttaaaacccccgcaatactgtctgtgtactgcgccttaattgtcagatgtttttttacgctttacgcaatatatttgtcaattgcatatttgtatagtataataaaaaataatccatttgagaaatacaaattatctttcagtgtgaatcagaaatttaataagaattacaaagtgccgggaggaatatatggataccgaaacattgaaaacatttttattattagccaacacaaaaaatttcagccggacagccgaaatcatgttcgtatcacaatctgccgtcacggcgcggattaaatcgattgaagcggaactcaacaagaccctcttcgtgcgcaacaaaacctctgtggaactgactccccatggaaaaatatttatccactatgcaaagagcatctgcaatctggatctggaatcaaaaaaagccctcgatgtatccggcagattcacgtcccgtctgtcaatcgcggctccggaaaccatctggcagtctacggtcttctcaaaattccgtacgctcatagaaaaatatcccaacatctcattcaacgtgaatgttctgcattccaacgatatcgtagacgggattctggacgacaatatcgatatcggctttgtgctgaaccgtcccacccaccgtatgatagagactgtggagctatggaattgcggctatgtccttgttaagtcacctgctctgaaactgaactcccgctatttctctcccgatacgctggatgattttccttacatcgatatggactgggggatggcattttcgaattggctcaatacgtatttttatccacgaatctatccgtttcacacgattcacgggtatctgtgcatgaatctgcttctggaaggcctcggcgtctgtttcctacctgagcggatcgcttcctcctatatcgaaagcggccggcttgaaaaaataccctatgaatattcgggctactcgcctatcgaatccggtttcctggtctggcctaaaaacaattccagtattttgactccttacctcgaaaccttaaaagccgcgtttcagggggaatccttcaccgtcaatccgtgataagcccggacactccctacacaggccgccgtttcctattgctcacagtcttcgcgttttaccgtccttgcacatccttcaataaataaggggctataaaataagtcccttattaggaatcgccagttccggcaaatgccggttctggtaaatttttaggtcatgtgatttttgattcatgcggtgtcctccttgtaacttaatgccatgatgttggggtcaaaaggtcttttgacccctttgataccggattgctccgcactgcgtgctcctcagattatgacaaactttatttgatgtgctgcgacgggtcgctgtagcgacatgattccctgccgacgcagtgcgatcctccgcggagcggtttttatttaacaggaaaactttcctattaaataaaaaatgcacgctctatgtatcattacataaagtgtgcatgatttaaatctataaatttatgagccctgcttccatctcctcaatatcaaatccaccggcccgcgcagcgaagtcaccaccatgatacctgcggccagcgctacggccagccccagagccgaccgggccttctcagcaaagacaggcagatccattctcagagccgcactcaccgcataataaagcgccccgcccgggataaaaggaattacggtcggcatcagcacggttgtcgccggtgtctttaaaatcctcgcccatacctcggcgtaaattgtgataagaatggccgataaaaaaaatcccaggtattgattatccacgaagttgataaaaacaagataaagcccccagaagacggcgcctccaacggcggaaatcaggattctcttgcccctcgtattaaagagaaccgcaaacccgagtgagccgaaaaaggacgcggctaccgcataacagaactctctcataaggaacctcccgtcaggatgattgctataataaagcctcctgcgacacagaccgctgttataatcgcctctgaaaaatgcagcaggccgctgatcatatccccgctgataaaatcacggaacgagtttgtcaacagcacccccggtatcagcagcatgatattgcctatcataatcgtatccaaatgccggccaagaccggcaaaacagacaaagatacataaaagccccgacaggatggaacagatgatattggagaatatctgtttcatcttcatagactgcaggccgtacaaggtcagtttcagcagtacgccgacaaatgcggcggcaaatccgtccctcagtgtgcccccgaaaaaaacagtaaaggccgccgccaccatcgcacagacggcaatctgaagagccggtggatattctttgctctttacaattgcatcgaattcctcttcgatcgcctgccggggcagatgttccgaacagattttcctggacagattattaagtctgtccagcttatacatattcgtgccgtagtttaatattctcctggtctgggtaatccactccccgtctgacgtttccagggaaacaatgatacatgaggcgatggagaaaatgtggctctggcggacgccgtaggcgctgcatatgcggctgatcgtatcctccacccggctgatctcagcgccgttaatcaggagctgttccccgatatttatcgcacaggtaagtatctgttcatttgtcatgtatttgattccttaattttcttaaaacgtttcaatgcatcgcggtatgccacaatgattgctttcgtggaagaaccatagtagcgtcttttaacctcagcttcaatttgctctgcatcggttacgaactttttgccgataaacagccttcggataaaatccttggtaagttccagagtccttgaacaatctacctcaataatctcttccgtctccggtatgatctcaaacgcaatataaaatgtcccgtaaaccttcgtaatcgcattatccagattcgtcctggactcgccgataatatataccgtttctccctgattcatatccctgcccccctatgaaatctacgccggaaactttccggcattactgatcacagccccgctgaaaaacgcggtttcacgccgtgtaacacgggattttcgtgcaattgcacacgaaaacacctcgcaggacagtggctgtaaaaagtaactgcccggctcctatttgttattatacggcaggtaatatttttctgtcaagaaaggacaccctctgtcatttcacgaaaggttacggttcagccttcggcttaaaaacgccgttgattgtggtgaaaagttcacttttcatcgcgtcgcaccgcacaactcgggattttcgcaaaaaacagcgaaaacacctcgcggaatacatcatggctgaactgttaccacgaaagctcttcatatataatttgtgaaattctgccgattgcctctcttccgtccttattggttttcaccccatttgtcagtacggccagaatataggggtgtcccggaagaaggatgattccgccgtcattttccagaaaatccaaatcaccgcacttatgcgccacttccacgtcctcaggcagatagagctgaaggcgtcccgactgctgctgccgtttcagaatatccagcatcagggcgctggctttcctgttcacacagcttccctcataaatttttttcaggatcagcatgatatcatcggcacagataaaattatcacagccctgttttttcgcttctgaatccatcatcttccggcccaataccgcttccttcagtcccagttctgccgccatcccgttaatcctgtccatgcccagcatctgtatcagaatattcgtggcctcattgtcgctgactataatcatcaaggtcagtatctctctcagtgaaaattcatggcccggctccagttccttaaggactccgtctccgccggttctcatttcctgcgtaatttttatcttttcttccagggacaattcccctgcgcagacacggcgcatcagctcggccatgataaccagctttatcatgctggccgaagggacacgcctgtccccgtctatggaaaacccgtcctgttcctttaaatcgaacagcgatacgcagatattccctgtctgagactcaataaattcattgatccggtttttcaattcttccctgtatgccatttcccctctccttcgcgcggagcgtgcaggtcaccgccttcaattaaaaaaggctctttgtcaatagttggggtgggatttgttaaaatcccgccccaattctatgaaaagggccctttttatgtttagttccaggttttactgattttgggcatgccaaataagcctccgcattaccgacctttttatcctatgatgtacagtgaagtatccgggttcggaaccgtttgaaattccggattccgtagctgctccgttttaatacctttatcttgttgttaaatccttctgtgggaccatttgtcagcccgtatttaaaggcattcaggatttcttttcgccaggccctgtaggtcttagcacaggcctcaaattccttgatcccacagctctgtgcattcgcaatccagtcatcaaattccctctgctgctgacgatacgcttccatctggcagatatcatagaaccactctttcatacggtgtgccagacgcagatcctcgttatagtgaagcattaaatcacaggcctgtttgttctcatccttcagctttttgtagcgggtcagaatgagtttccggctgcgtttataatacttacgcagagaaaccggcatggaccgctgcagccgtttgcgtacattttcaatcgcccatgtcacctgccggatgaaatgatatttatccacgatgattgtagcgtttggaaagaaggtctgtgcaagttcggtgtaggggcgccacatatcgcagacgaagaactttaccttcaggcgttctttcctgggaatgttccgccaataatcagccagatggctttgggtccgatccgggagaatgtcgaggatccggcgctttttcggatcaaccagaatgcactgatatttaccggtagaagcattgcctttgaattcgtcaatggaaagcgcttgtggaagctggtcaggcggaggatagcaaatcgtgtccagaaggcggcagaccgtctggacggaaacaccggtaagctctgcgatctgttttaaggaaaaggtctgccggagcagggagacaatgtaaaatgccagcctgcgggtcctgcggtggtagctggggaggaacgaatagggttccgtgaaccgtttgcggcagtatgggcagaggtagcggcgtttgcgaaggagcaggattacttgttttcccagtaagggaatgtcctggacttcttgtaaacggtaatcatgaatccgttttgttttagccccacagcagggacaagtctgttctaccggttgggactggatgaaaattttaatgaaagagtctgcctgaaccacttttttaatagaaacaccttccaagttaaggaaagccttggtataattagggtacatctataagaggtcacctccgtaacattaaactttggtcgggataatgcgtttaggaggcttcttatagatgtattttattacaacgaaaagaatgttggaagtgtgcttttcagcacaccccaacattcagtatagaaccttaaaaaacccggcaaaaaacaggtattcctgttctttgctgggtttcattcgctccaatatagtgtttgctatatcatacaaagtgaagcagctcttcatttgtatttatttggtttgtgctttatcttttgtattttgaaatgttatcttttgtcgtcgtttcttttgtatttctgttgttcttttgtggatgccgtcttttgtacttttgtgtacattcttttgtacttcgtaaagcgcttatgtactttccgttacaaatcctttgtatctgcgtactttttctttggtaaaccttcttatgtaagttatcttttgtatatggttaaccacgaactaagtataatataaaatgagaggcttgtcaattattaagacgtatttgtcgaaatatttgtcactgcttattccctccggctttacagccgtcataatattccttatatcttccaaattttttccggtaaatatctgtccggaccagatccggacaaacgattcccagaggcggcacgtcgtaatcctccagattctcaattcttcccatcagagatgctgacttcccttctctctattctgcacatttaacgactaaaacccgtaaaagaacggatatttcagttcttttacgggttttatctgcactaagtaaaatgaaatacgtcaggaaaaggccaaaggccatcgccgtctccactacccggattttccagagagaaattcatatgaagcttgagtaaatcctgcaatggaaatgtaagaattcttaggatagccgtaatagcaacagaaagagaaatagtttagaataataataaacgtatcaaaccggtggttgtccggcggcagttttcgtcaatgctgccgcacagccgccttaacagaaaggggaaattgtatgaagcttctgagaaccgtcgctctgtttgccatatgcctgacagcgctgctgtccgcagccggctgttcggaaaaaggaactgaatcttttaacgccgttatcacggagattaccgaggacggaatcactgccaggccgtttgaggatgaagagatactgaaaaaagcatctgtcatcagactggaccagtctgtactttccgccaatccggttccggattttttacccggcgatacggcgcgcattgtgtggaacggaaaagtgaagaaaggagaacctgcttccctggagcatgtctttgccgtctacagtctgccccctttgtacagtgaagaattgttcaacgccagaaatgaatatatcggcgacgcccccgcagacggacggcttctgggccttctggccgagtatttcaacatagaagaaaaaaggtcgttggaacttcaaacatccggagaaccatataccatgacggtacatttcgaaagtgaaccggatctgagacgcatgagccagacggcatgcagcctcctcgccctgatcggaaactgcggtgaaatccgctgggattatccctctaaaggcagcgatgtaaaagaaggcgtcagtatcaccacagctgatgccgaagaactgctccaattagaagatttgaagaagtatggtgaaacagaggaatcgcttcaccggcttcttgagaacattgtacggcttaccgagattaaccggtagccattcccgcaaacaataaactttcaaaaccggctgcaggaaaggaaatgggaatatatgggatattttatcaagaaacaaaacagaaagaatataacaagattttttacgttcctgtcactctgctttctactgtcaggaaccgctcctctgaccgccctggcccatgatgccgagtggggcatgtggcgcggcgagcagaatgcactgatcatcggtaccataacagaaacagaggggaacctgtatcagattacggtaaaccacgcactcacctgcggcccggaaggcgctgaaaaaaacgtgatagacaggatgcttccgctcagcgaaatacccggtgaactgacggcagattttaccggatatcagggagaactgtattcctacaccacttcctaccatggcagggagaagccggaaaagggtgatttcgttcttctctccctggataagaagggagaaatctggaagctggtctggccgccctatgaattgagcggcaccgatccccagacacttgagctgcttcccgaaaaagagaagaccaacacggctgctgcctgggagatattcatccgttccggcggcagtatcaacgacttctttttttccggcgcaaacagcctttcggcaaatattctgcaggaggacggctccgtcaaaagggaactgctgtgggagcggcaggaaggaacggagtctgaaacggctgataagagtacgtccggccggaacatatcagatgaaacagccgccttagccggtgccggtgacagcagcggcgcggcagacggccgaaaccgccttatcagagagacgggcgaaggttcataccgctccagcttctggcccttgattgctgtttctgtcgttgtctgtattctctgtttcggtcttggagttatttgggaaatacaccgaaaaaagaataggaaataactggagcgtggctgaaaattgctttccgtcagatgtgcggcacactttgcggcacatttggcgggaatgaattttgagacacgctctaatgcgccgtctcttgttcttctttcaggtagcaaacaagcgcccccaacagattggacacattcaaatattgacatgtgaccacctcggctcttctgactatataggtgaattcactgtatatttcatccagattttttctgatatactccatcagaagaggctgtccgctgatcccgccgccgatggcgaaccgctccggatccaagatgttttgcagattaaaaatctggatagcaagctctctcgtatattcgtcaaggcattccagtgcttccttgtcgccgtctcccgccagcaaaaacacctgtttcccatccagcgcttcacagggcagcttctttttctcagccaccctctttacaagcgacactccgccgcagcggtttccccatatattcccggaatccggcttttccgtacccgccgtgcagataaaggatacctctcctgctgaaaaatgacttcccttgtatagttttccgtctttaataattccgcccccgatcattgtacccaggacgaggactactccgttttccacatcagacagacaccccagctccgcctcagccattgccgcacattttccgtcattctcaatatggatttttgttggacaccgctttaaaagagcttctttcatggcaaagccttcgttatatcgaagcgctcctcctgtgtaaaagtatcctttccggctgtcgataatccccggggccgcaatagccatgccgtctatctcacccgcaaatctgtcatacagcttccccagggcctccaccagctcatcgcgcccctcttttggggtggggagctgatccgtcatcatcacataatatgcttcgtccatcagcgcatattttatgaaagaacctcctatatcgattacaagatatctcatcacgccacccccgttccatcaaaaaccactctataattgtgtcaggtctttaccgtcaaacacgctctcccagtcactcttaaaatcagccaccgccttgccgatggccgccatccccatcgcctcgtggagaagctgcggcgaaagcgtcgccgtctgggccccggctgcaaaagcagcattcacctgtgcgatatttttaaagctggccgccaggatttttgtattatatccgtaagctctgatttgctccgccagacaggctatagtgtcataggcatcaatatccagattctccatcctgttataatacggcgcgataaagtcggctcctgtctccagcgccagatatccctgaattttcgaatagactgccgtagcagtgactcctatcctgtcttttttcaaagctctcatcaccttcagaccgttttcgttaaccggcaccttgataaataccttatcatccaccttatttaaaaccgtgtcggcttccctgagcatcgtgccttcatccggcgccgtaagctgtatatgcagggaacgctccgctccgattattgctctgatttgccggaaatgacgataaaaatctatcttcccctcttttttaataatagaagggttgctggtcactcctgtaatgggataaatggcgatgtatttctgtatctcctgaatattggccgtatcaaataaaaactccatgtcttcctgtcctccgtttcctgctcttaaaaaactgccgttctaaaaattctgttccgtcctctctataatatcatcctgtgtctggcgtgacaatgcattaaagaaagccgaatatccggcaacccggacaatcaggtcgcggtactcctcgggatttttctgtgctgctttcagtgtctctcttgagacaacattgtactggacatgatagccgtgaagacggttaaaaaatgttctgagcagcatggtcagtttctgtctgtcttccggttttgacagaagctgcggcgtcaccttctggttaagcaggactccgccggtaatttcctttgtgggcagtttagcaaccgtcttaaatacggccgtcggccctttcctgtccatcccgtggctcggtgagcagccctccgccagaggttctttcgcctttctgccgtccggtgtggcgagcgttcccatgccctggcccacattggccgaaatggacgaggttccggcataatagatgcctcctatcggccccctgccgtatctggtgttatgatatttctttatctcgtcgatatatacctcataagcgcttcggataagagaatccacataatcctcatcattgccgtatttaggtgctgccagcagaagatttctaatccagatccccttctccccttcaaagttattcatcagggcgtcccaaagctcagccggagtcatgcttttatcctcaaaaacacatttttttattgctgcgagggaatcagccatgttggcaattcctacctggaggccgctgataaagtcatagacggctccgccttctttcagtgtctttccccttccgatacagtcctccaccagagaggaacacagcacgtcgggcactgtctcctccagaaccatatcacagcaggtctctataattacgctgtgcttcgtgaaattcctgataattttatcccaggcacgttccacgtctccatagcaggtcatatccctgaaatgtcccgcgccttcacacagtttcactcccgactccggatccacgccgtcattcattgctatcagcagggatttggggaaattcaggaaactcattccggtgcagcggtatccccatttccccggcactgccgtctctacacagccgattgcactgtaattatacgcgtcttcctccttgactcccttttcaatgaaggaggggataataatctcatcattattaaaagctggcatgccaaatcccaggcgcaccacttcgatgcattcgttcataaattcagcgctgagtccggcatggtaacggaccgtcagattgggctggggcagctttgtctgagccacgctctttaaaatcagccaggtcatcggattcaccgcgtcttttttgtccgccgtctgtccgcctaccgtaacattctggtacagcggattgccggcgctgaactgggtgtgggaccagctcctgattttgttaatcgtgaaggttttcagccagaggttcgtcattttctcgcaggcgctttcctccgtctcttttccgctttcaagatccttcttataaaacggataaagatattgatccattctgccataggagagggaatggccattggattcaatttgcagcacaagatggatcagccacatggactgaagcgcctcagcgaagctttccgccggttcatagggaacctttgaaagaatgcgtgccatttcccgaagctcggccgccctcctcatttcgtcaggttcccccttctcaagcccggccgcctgggccagagcaagctctgaatagcgggatgcaaaatttctaatggcctcaatgacaatcaggatcgcctggtaaaaataaaatttctttaaattctcagcctccgtaagctccagccgttccatcgcttccctagtgcgcctctcgtaatccttaagtcccagtctcatgaccttttcatattccacggccaaatgtgcatcaccggaagtgatattcccctccgccttaataatcccgaggtcatagaaaatccggctcgactccggcattgccgcaagtcccctgtccttcgtcgtattatgttcccaatacggagccagctccctaagcttttcctttgtctcctctgttatgtaaaaaacatccccgtctcttttctcaaaccggtccagttcctccatcacccagtccatcgcatattccggaaatatcggagccgcccggttggcagacgcctggtttcctgcaagcagggtctgcggctcaatgtaaattgtcatatgttccaaaatattccggagcatataggcccttttgagaaccaccggcttatccgcgtgcattcggtagctttccgtcgtaagtactgcacgctccgcgcagacatacggcttcgcattcagaagttcttccctgaaattatgcatacgttccgtcagctttccaaagtgattgttttccatggctgtttcctcctcaaaacgttgaaatgtaaagctttgcgattctttttttcttaattttccggcgtttttttcttcgaatgaaagaaggtgctttcctcaatgctgttttcttcggacattttgccgataaattaagctatcccaaatcctgcaaagacattttgccgattttttatatttttattgatttcagtgtacgccttttatttcattttgtcaatattttatttacgtacgaaacttatttacttttgaatcctgttgtgatatagtatgcaatgattacgattcagacgtcctttcattttttataggagcttatgattatgaaggcaaatatttttaatattcagagattcagtatccatgacggccccggaatcagaacggtcgtgttctttaaaggatgtcctctgagatgcccctggtgttccaacccggagtcgcagcatcgccctacccagatactatgggacaagaaaaaatgtttctacggtcatctgtgtgaggtgaaatgccctgcaggctgcctgaattttgaaaataacaatctggttttcagtgcagataactgtaccggatgcaaaagctgcatcacccaatgtcccggaaaagcgctgacatttgtaggaaatatgatggagctggatgaggtcatggaagaggtgcttaaagacatggatttctatcaggaatccaaaggaggagtcactctgtcgggcggagaagtccttgtacagcctgatttcgccgcagcccttctgaaaaaatgtaaagagaacggaatccataccgcgctggagactacagctttctccactccgctggtgttttccaaggtcctcgcaaatacagacttgcttctgctggacatcaagcactataatgacagggagcatattaaatacaccggagtgtccaaccagtcaatccttgaaaacctggactttgccgtaaccatgaaagttccggttgtcgccaggatacctgtcattccatctgtcaacaataccatccaggatgcaaaggaatttgtcaagctgctgaaggaacacagggtagatacggtgaatctgcttcccttccaccaatttggtgagaaaaagtatgaagagcttcaggttccctatcagttaaaagatgtcaaagcgctccgccccgaagatatgactgaatactataatgtttttaaaaatgccggcctgaatgtaagcatgtagccttatggttcaccagcacggacaggcagaaatataaatgggtgtcagcccggacagtccggaccgtcacataaaaacaggcaatgcagacagttatcgtcactgtttgcattgcctcttttccatataatccgtgcgccaaaaactcttaatttccttcttccggaacgcatacccggatcccctgttcctccagaagtttcttcgattcattgggaatcccgttatccgtataaacgctgtgcacttccgaaagcttgaactgtaccacaactccctgtctcgaaaatttacttgaatccgtaacgacaattaccttcttcgcagactgagccatgcttttcatcgcctccgtccgcatcatgtcaccgccggtaaaaccgatttccggcagaaaaccgtcggttcccacaaacagtttatcaacgaaaaattcccctgcacattgcctgacaagagggcctaccatgacctgtgactccttttggtattctccccccagaagaattactctccctacggatacttctctaatataggtagctataaatgcggaatttgtgataatcgtaacatccttcttatccgccgccagctgctccgccaggagggcgcagctcgatcccgactctatcatgatggtttcaccgtttaccacactctttgccgcttctttagcaatttttagcttcgtatcataccggaccgccatcctgttattgatgtcgtccacattcttcataaccgcatagccatgttccctggaaagaaggcccctctcctccagcacatcaagatccttacgaatcgtaacctgtgaaacacccaacatctcagataaccggttcacttctacttttttctcttcactgacaatatccaatatcttcgtatggcgttctgtcattcccgatcccgcggcgatgccgctctcctttccatgtcatattgcataagaggtactgttttactagtatagcacactccattttcgttcgtaaacaagaaattaattaagcaggtgaggacgctgccggtacggccggcggacggggtggtgaggtgtgtatataagtctttcgtcccgggggaggattgtcgtggtatgggacttcgggcgaagataaagtctgcggagcacactcccgctctgtgaaatgcatcgcgctgctaagctcgagaggacctcgctaatcagcgatggatttaggcggcatccgcagactttatcttcccctccgccccaaggccaggttttcgccgggacgaaagactccgccgggtgtaccggccccgtccactggcctgcggcctatgccttcaatgcgcctttatgaaagaattgcactagagttgatatctgccttcggaaacacgtagtggccgctacaaggccctccccatttaaggttagagacaatcagcgcccggaacggaccatgtccggtgccggaaaaatcttcgcctgagtcttccgtccccggcgataatctgcccccgggaagtaggcggaatcaattgcgtaggggacatgggagtccgccggtgcttagcgaggttcctcacgagcttagcactgatgcgcactccaaagagtgcaaacggtccccgcagcaattcattccggccggattccccctccacgaccaacctcccacggggacggaagactcagcccgcccccctcaccacaccggacatggtccgttccggacgcgtcctccaaacctcagttaaatctccatttttttcaagatactcttgtatttcttcaaattcaatgctataatatgttcaatatttgatttaaaacaataaaattgaacaacaaggaggcagctatgaaagaaaacatcaaaacgactataaagaaagagctggactgggttacgatggcaattccatttttaattatccttttactctgcatcagctttatctttctgccggattcatcaaagcatatcattgagtcaatccgtacctttttaggagaggaactgggaacttattacctggccgtggggctgggagcttttattctctctctgtttctggcattttccagatatgggaaaatctgtcttggaaaggggagcgaaaaaccgcagtattccaatttcgcctggggatccatgatgttcacttccggtctggctgccgatattcttttttattcactctgtgaatggattctctacgctcaggatcctcatatggcggagatggggtcgattcagcaatggtccggtacatacccgttattccactgggggccaatcccctggagcttctatctgattctggccgtatccttcggatttatgctccatgtgcgcggctgccataaacagaaattttccgaggcctgccgccctctgctgggcagccggaccgataaggctccaggaaaaatcattgatttgatcgccgtattcgccctgctggcgggtaccgccaccaccttcagcctggcaactcctctgatgagccagattgcagcagagctgctgggaattgataactcaaagtggattaccattttaatcctggttattacctgcattgtttacaccttctgcgtagtcagaggcatgcacggcatcatgaagctggccgcttcctgtgtatacctgttcttcggactgctggcctatgtactgatattcggaggcgagacaagatatattatagagacaggcttctcctccatcggaaacctgattcagaattttgtgagtctttccacctttaccgatccgcagagaaccacctccttcccgcagaactggactattttctactgggcgtactggatggtatggtgtgtcgccgcaccattttttatcggcaatatttcaaagggacgcacggtaaaacaaacgattctgggcggatatatttttggtcttggaggcacatttacgagttttattatcctcggcaactacagccttggtttacaggtgttcggcaagctcgacgtgattggactctatacggcaaccggtaatctctacactacgattatcgctattgtccgcacgcttccgctggcgcccctggtactgattcttctggcgctcacgatgattgccttttatgcaaccagctttgatgccatcgcactggtcgcatcttcctattcctataaggaacttgacaatgacgaggaacctcatatgggtatcaaggtattttggtccatcatgctgattttgctgcctatcgcactggtattcagcgataattccatggccaatctgcagacggtatcgatcatagctgcctttcccattgcagtgattattgtgatgattattgtctccttctttaaggatgccaaaaaaatgctgtaagcgttaagacagcttccggctaaaccggcgaacctttttattactgttcacaggttgtattccgcgagatgttttcgtgcgcattttgcacgaaaatcccgagtttcgcggcgcgaaactgcgttttttgcagtttctgtgcatcgcgaagcgtgttattgtttacagcatgccgcttttgggcatggtgtgaacagtaacacctttttccggcgcggaatatattaaaaagaaaaggctttgtcatgcccgattccaatatgtcttttcccggtattattgattatgtcgccgtccacggcagtaagacactggaggaagttcctctgtctgctgtggacggccttgttttttccgcaatgtcttacattcactttgacggcctgataccagacagtccccaggaagcgcccgcggtcaaagaaacggcggccgccatactcgcgctgcctgagaggaagcggcttttgcgtgtccgctcactggaaaaccagcgtctgcttgaggaaatggcaaagagccgccgcttctccggcctgcgtctgactgcttacagggatatcaaatcgcctgaccttgaaatgcagttctccgccatcactcttcttctcggctccggagatatctttgtcgttttccgcggtaccgacggaactttgattggctggaaggaggatttcaaccttggctttcaggatactgttcctggccagtggacggcctgttattatctgtcgaatatggcctctcttgccgcgggctctgtctgggtgggcggccattcaaagggcggcaacctggccgtattttccgccgcctgcacttttcccgatatcacgccgcgaatccgtgccgtattcaattatgacggcccaggcttcagccaggcggttcttgatacgccgggctaccgcactgcgcttccccttgtccgaacttttctccctcagtcctctgtagtaggcatgcttctggggcatgaagagtcctataccattgttcagagcgggctgaaaggactgatgcagcatgatccctattcctgggaaatccgggacggagacttcattcggctgaaagaaatcacagagggaagctgtctggttgaccgtacgataaaaacctggatttcagagctgtcccccgaggaacggcgggcgtttgttgatacggtcttcgatattctccggtcttccggggccacccggaccggcgagcttcttctgccggataatgttatggagataattggaagcttcctgaaggagacctccgtaaagcgcgacaatatcctgctgccgctgacgtctctgctcaaagcggcaggcaaaacactcacctccttttacctcgatgcttcgtaaaatatccggctgttcgggactcaattacagcttaactgaagataccggtaagatacaggacccatcctgctcttaccggtatcttcgtaacaggtcagcctttggccaaactgttacgtatcttccatattccgcctactggtaaatctggttgattttccagtaaccgttgaatttgtacatattcagtcccgaatctccgcccatcataacaccggcgcttccaacctcttcgagacgcgtgatatccgtattatcaatctctttgctcagcttttctgtgaacaccttatcttcaccaagggctatcagctgctcggctgacttaatttccgtcatctttccattggaattggtgataattattggataattacacatcttagacaaggtttccaggctcttgtatgaaaatgtcttctggatttgttccgccatctccttcatatcgctgatatttactgaattggaatttacggttgaacccgcatccaggtaaaagttattaatcttccattttcccttcaccttataaagagtcaatccgtaatctccgcccatcattgtaccggcctgctctccgtccgtcagcttcgccacattggtagaggcgatcgcatccgtcatcttctgggtgaagatggtctgggagccaagggccataaactcttccttacttttcaattccgccagttcgccgcttttaaaggagacgaccaccggatagctgcacagatcggccagtttgtttaaatcctttttttcaaatgctttctgtacctgctccgccgccttgctcatttttcatttctggaattgctggactgctgggttctggcgcccgcgtaaaccggtactgccggtatgatacttgtgagtgcggcggctcaaactgctgctgccataaatctttttgtgaaaaataatctcatctctttctcctcatttcttataaattcgtctgtcctgtttcactttcacagattagactctgccggagaataaaaagtttcaattatcttctattatttcaatcctcatactcatacaagagaatcgaacattccatagagcttatcattcatctctttcacctgatcctcatccagcttcacaatctcccggtcataggtcagcacaccattgatctcttcctcgatatcactggtctgcgtgtaaattgcactgcacaggccatactgtaaattcggataaatttcctcttcccaaagcctcttataattttgcgtcagctcttcggtggaatggtaatgctgatagccaaattctttcttacaggaaagatgttcctccaccgggtaggcgtacccgccgtattcggtcagggcgacaacccggtcctgctgcggctttaccttcagcttatgcctgtaattatggatactgtacatatcgccgccgccctgatcaaaccagccgcaggcctcgttaatcagacgcccggaatcgatttccctgacttcttttgtggccttcgcagcgtcaaactgcccccatccctcattaaacggaacccataccgctatactggggtaattgtacagtgtggataccatattcttaagatcggtgtaatactgtctccgtccttccccgtcctttcttttgaatattccgtagtgacggtcgctgacccccctggcgaaccggtccgaggcattggggagatgggtcacaaaaaccatgttgtattcaccgcccccattgggcatatcctgccataccatcatccccagccggtcacagtggtaataaaaacgttccgcctctatctttacgtgtttcctgatagtattgtatcccatctccttcagcttgataatatcatataccaaggcctcatcgctgggcgcagtcatcaggctttccggccagtagccctgatccagaatcccgttaaagaaatacggtttgttattcaggaaaaatctcagaatgcctttcccgtcccggccggtagatagtttgcgcatcccgaaatagcttctcacctcgtcctccccataccggattatcacatcatagagatggggcgtatctggcgtccatggcttgaacccgtcaagctttatctcctggctgattaccttctttatctccttctcctgccggacggtaatctctgcctgcccgatttccaccccgcgttccagaacagccagacgcactgtgccggatgtctccccaccagatgccttcccaccggatgcctccgcgccggatgttttgcaggcattaagaaccgttatctcaaaccggaccgagctgtcgtcgtaaagaggcgtaatcctcacgtcttctatataggccttttccacgctttccatccagacggttttccatatcccgctctgaggtgtgtagaaaagagaggcgtattttccttttttctgcagtttctgcttgcctctggcatgaggggactgctccgtccggtccgtcacggaaagagtaagcacattctccccctgcctcaggctatccgtgatgtcaaagtgaaacggaaggtatccccccttatgacctcccacccggattccattgacaaatacactgcactcctggtcaacggcgccgaaatgaagaagaacccggcttttcttaaaaccttccggaagagtgaatttctttctgtaatgaaggcgctggtgcggcatcacgattttacccacgcccgagagcatggattccggggaaaaagggacaattatcgtttcatcgtagaaatctgccgtttcggattcattgatacggcattcccactctccgttcaggttaaagtaactgtctctcactagattcggccgggggtattcctgcaaaatatttcccgggtcaatttccttcccccatctgctagttaactgtatcatactttatcccacctgttttcttttaaatttgatattctggaacacctcggactgtaccccgactgaaatcagcaccagcattcccatgataatcgactgccagtggaccgagatactggtaggaaggtaagtaaatattgtgttgataataaaataaatcaaaattccgaagaaggtgcctgagaatttgccttctcctcccgacagctttacccctccgattgcgcacatggcaatcgcatacgtctcatagacattgcccgcgctcagtgttgcactgccgctgctggaagccagaagaataccagacagggccgcaataaaaccggaacagataaacgccttaattttgattttatccacatcaattcccatcatccgggcggcctcgccgtttcctcccaccgcgtacatccccattccaaatttcgtatgcctcgatatatacatacagataaatgtgacaagaaacaggagaggtatcagaatcgaaattccgctgttcattccgggtatcacgccctttaaaacctttgttcctgcgaaggtcagaacattcccggtcaccgccaccgatttcttcgcaataatcagaatcactccgcgcagcgcgaagagcatggcaagtgacgctatccatgatgagatgcgcatcttagtgaccatcaggccaatcataaggcccgagacgacgccgactaaaagcccgcagacaattccgaacaccggattcacctgggccgtaaggcccatgaccacaccgctcagggcaaacacggcgccaaccgacaaatcaatctccgcacacagaatgacaaatgtcattcccagagccaaaaatccgccattcttagccgctttcagcaaaatattaaacacattggcagttgtcaggaagtttttatcctgaaatagaatgcttgtaataattaccagaagcagaaatgctaagatagtacttctcgaataaaacgaattatatattttctttattaatttcatacttcttaacctcctacttcgcctgctctctctgaatgaataccgcaaatacgataatcgctgctttaaacacctgggcatactgatccggtatattattcatcacacaggtcagtgtgatcatctgcataatcagggccccgaccacggttccaagcacatgggccttgccgccgctcatcggcgtgccgcctatgacgaccgccgcaatggcatccagctccgcaagctgtcccagggagcttcccgctgcgaccgataccttcgccgcctggaaaatcccggcaaatgctgcaaaaaaggtactcagcccatatacaatcatcagtgtcctggctgtgttgattcccgccagggagctggaccttaagttatctcccaccgcctgaatctgacgtccaagcaccgttttttcgatcatcacccagactgctgccacggacaggacaatagggataatctgcaccggaatcacgcccccgagtttgtaggttccccaaagggatagctgttttcccacttcccccagcttgttgaaatagatgtcgcggcctccgcaaagcacctgggccacgcccctcagccccagcatcagtcccagcgtgataaccattgcctgtaatctgagcttgccgaccataattccggtaaagcagcccacgacgacagacaccgccacagcggcaagcacagcggcaggaagtcccgtctccggcatcagcctggctgtcagcacccccgccagggccatgaccgaaccgacggaaatatcgattcctcccgtggagataacgagtgtcatccccatcccgcagaggatggtcggacaaagctgggtaatcacgttatttaaatttcctatcctgaaaaagttcggggtgaataaggagtttaacagcacaaaaaacaggagcagcgtgattgcgctgtatttttttacgaactgaagataatcctgttttgtcttattcatgcgtttttccctcactttcactgcctcttgcgatggtttccatcaccttatcctgactgatctgatccccggccagttcgccgatcactctgccctccctcatgacgataatcctgtcgcaattccgttccagctccgcaatctccgaggaaatcatcaaaaccgatattccgctctttgaaaattcctggattaactgctcaatctccgctttggcgcccacatcaattccccgggtcggttcatctaaaatcatcagctttggattcatgcacatccatctggcaagcagtaccttctgctggttcccgccactcaggttacagatggcctgctccggcgtcggcgtctttatcttcagccggtcaatataactcctgactatttcatcctgttcctttgtctttacaaaaccaaaggaattcagtttcgggagcagggcaatcgtaatattttcccggacggacaggtggggaataatcccctccgtcttcctgtcctccgtacagaaacccatccccttttttatcgcatcggcaggagaatgaataccggccttttctccccaccagaaaatttctccgttatcaggcatgccggaaccaaacagcacctgcgccagttccgtcctccccgagccaaggaggcccgcaaggccaaccacttccccctgcttaatctcaatattgatgccgttaagccgcatcccctggcggatgtccttcatctcggctatgaccttcgcattcgcgaactcatatccctgcttgttcctttcaagctctaccgtgtcctttcccaccatcagtgaaatcagcttaagctggttcagctcaccgatatcgtagtctcccacatactcaccatctttaaatacggtcaggcggtcacatatttcaaaaatttcatccagcttatggctgatgaaaatcacactgattcccttacttttcaactgtctgataatcctgaataacacctgcacctcatgggtatccagcgaagaggtcggctcatccataatcacaagcttcgcattgatgctcacggccctggcgatagccaccatctgctggatcgccgtggaataattttttaacggcctggtcacatcaatctcaatccccagttcctccagaatcctttttgcctcgctgatcatggcttttctgtcaatgctgccgaatttcgttctcggttcccgtcccagaaaaagattctcataaaccgtctggaacagaaccaggtttaactcctggtagatcgtggaaattcccttttcgtttgcctctatcggcgtcttggcatttatctcttctccgtcaaagcaaatcgtgccgccgttcttctggtagattcccgtcagcaccttgatcagcgtggattttccggccccgttttcccccatcagcgcgtgtatctcacctttgttcaccgtcagattaactcctttaagcgccctgacgccgggaaatgtcttctccaaaccttttatatccagtaaaacctctgccataagcgtctcctttttacattactgttcacagactgccaaacagcacagtcctacggccgatacagtaacctttttcctactcttccttcaatctattccttcaaactattccttcaaaaaggctgccgcaaaaaatctgatttttgcggcagtctttatagcgcgtgtttgaaaattgctttcgtcggtgacaggctgcagaaacgtgccttccaccgttcatgaacgataaatcattagaaacctaattccactaccacgttatcctttgtataaagggtatcttcattcgtgatatgagccggaacctcttttccatcgatgatattcgtaatagtttcaactacaatctcgccaaaatacggggagcaggtgcaggaagcaagctgtcttccatcttcaatcgcctcaaatgccgccctggttccgtcgattcccagtgtcaggatatcttcgcccggtttcagccctgccgcttcaatggcgttcattgcaccctgaaccatatcatcggttacgcagaatactgcgtcaatattctctccgccctgggcctggataatattctccataacagcctgagccttatccatcagccactcgccgtcctgttccgctacaatcttgaacttggaggagtcaaggccttttacaaatccgtcctgtctgtctgtggaggtggatgaatcatagccgccgttgataattacgacatttcctccgtccggcaatgcttcggtgagcgctttcgcacactgctcgccttcccagatgaaatcggacatgatcgccgtcgtgtaatgggttcccgcttcaccgtcaatcgccctgtcaaccaggataaccgggatattgctttccattgcttcctgtaaagcgccctgaagcccgttattctcaagcggtgcaacgacgagataatctacgcctgccgctacgagatcgcggatatcggactcctgcgtggcaatatcgccgcctgcgtctttcacgatgaattcgccgcctgcattttcaacatactccttaatgctgtcagtctcagttgtcctccatgccgacatactgtcggtttgggcgaatcccactttcttaccctccagcgcttttttgctctccgtgctctctgccggagccgcttcggatgagccttctgccggagctgctgcctccgtcgcaggcgccgcagtttccgccggtttctcagagctgccgcatgcggtcagtgacagtgccattgttgctgccattgctaatgcaaccattttcttcataataatttcctcccttacttattgcgcgtttttattacataatttattttagatcgtttcgtctctttttacaatatacttttatatattctttttatttttgtatatatttcacatttttatcgtttttattttgtaaaagttgcttttttactttactttttatgtaataaagagttataattaatagaagaaaaatataaaaaatggaagaaaggaatctgtcatgtcacccagggaaaaacgtactgtcagaattattggagaaagaaatatttatctgcatctgggcaatcccgcccatcatgagtcaattacgaaaataggcaaagccctctcttcgcctcttcgtctgaaaatcctggatatgctgagaaataccgcgcgctccctgcaggaaatcgcttcgattctggacatccccctgtcctccgccgcgctccatgtaaagacactggaggaggcccatctcatcgtgacggagactcagcccggggttcacggctccatgcgggtttgtacctgcagcatccagtcctttcacttagaaaccttcgattcctccatcgactccgtcaataagagtatttccatggatatgccgatagggaattactattcctgcgatgttcagcccacctgcggcctggctgatgaaaacggccccatcgactcctatgacacggtccgttccttctactctcccgtgagaagcagggcgcagctcatttggtttcacaaaggatttattgaataccgtttccccaatatccacaacccgctgctcaccctgaacgaaatctccttccgttttgaactgtgttcagaggctcccgggtatctggaaaactggccctcagatataactatctcaatcaacggcgtggagacggcggtctactgctctcccggcgactatggcgcccggcgcggaaaactgactccgccggcctggcccaatggaaatacacagtacggaatgcttaagacattctccgtcaaagaaaacggcagttatatggacggacgccttgtccatgccgggatcagcctgagggacatagccatcgaatccaggccctatatctcactgaagatcgaaatcaaagacaatgccaagcatatcgggggaatcaacattttcggggaaaaatacggggattatccacagggcattgtgatgaacctgacttatgaataacgtggtaacagttcagccatgatgtattccgcgaggtgttttcgctgctttttgcgaaaatcccgagttaagcggcgcgaaacgactttttttgccgtttctgtgcatcatttgttgcagtttggccgaaggctgaactgcaacataacgtgtggatatatcagaaagaatctcgcgggattcccctcggagcagtttttatttaacaggaagtttctcctgttaaataaaaaaacgcggcaggagcatattacattcccgccgcatttttgcgtttcaagctttcttcgattttgttatttgcgctttcctgcctcgctgagccgtgacatcgccctggccagctccatcttgcttctgtggtattcggcaatggactgcttctggcgcagctgctcctccgcccgctccagcgcctctttggctctgttgatatcaatctcgccgggatgctccgccgagtggacaaaaacctggactcggttattgatcatctcggcaaagccggagcctgtaacagccgtgatctcctcgccggtttccgttacaattttcgtagtcccgggtaccagggcaataattacattttcatggtggggcagaaatgtgtggcccccgtccgtggcaggaaggttgataaatctggcccttcccttgtagaaaatctggctgctggaaaacagctcaaggccaaatgtggatatttctcccatacttaccggcctcccgtcttctcctgctctgtcttttcatgatctgccttcgccttcacatcctcaatcgaacccacgttaaagaacgcattttccggatagtcatccatctcaccgtccaaaatcatcttaaatccgcggatcgtctccttcagcggcacgaatttacctggtacgccggtaaatgtctctgccacgtggaaaggctgggaaaggaatttctgaatcttcctcgccctgtatacggttgtcttgtcttcttccgccagctcctccataccgagaatggcaatgatatcctgaagttctttgtatttctgaagaatctcctgcacccgcctggccgtctcgtaatgctcctctccgactacctccgcttccagaatacgggaggtggactccagcggatccacagccggatagataccctgctccacaatctttctggaaagcaccgtcgtggcatccagatgggcaaacgtcgtggcgggagccgggtcggtcaggtcatcggcaggcacatagaccgcctgtacgcttgtgacggagccctccttcgtcgaggcaatcctctcctggagttctcccatctcattcgccagtgtcggctggtagccgaccgcagacggcatacgtccaagcagggccgaaacctcggaacccgcctgtacaaaacggaaaatattatcaataaacaaaagtacatcctgatgctccctgtcacggaaatattcagccatcgtaagacctgtttccgcaaccctcatacgcgctcccggcggctcattcatctgtccgaataccagggcggtcttttcgagaacacctgattccttcatctcaacccagagatcatttccctccctggatcgctctcccacgcctgtgaaaatcgaatagccgccatgctctgtggcgatattctgaatcagctcctggatcaggacggtcttgccgacgccggcgcctccgaacagtcctatcttaccgcccttggcatagggcgccagcaggtcgattaccttgatgccggtttccagaacctccacgaccggactctgatcttcaaacgaaggcggatcgcggtggatgacccagtgttcctgatccttaagaccttcccctccgtcaattgtctctcccaggacgttgaaaaggcgccccaggttctgatctcctaccggcacgctgattccctgtcctgtgggaatcacctccatatctttatgaaggccctcgctggcggccagcataatgcagcggaccacattatttcccatatgctgggcggcctccatgatacaagttctgtccccgttttgaaccttcagggcatccctcaggtggggcagaactccgccttcaaacgaaacatccacaacaggtcccatgacctgaataattctgcctgtgtccataattatccctttcttttctgcgcattggcgccgctgactacttccgtaatctcctgcgtgatagccgcctgtctggcgcggttatactggatggacaaatcccggagcatttcctttgcattgtccgtggaggagcgcattgccatcattctggcattatgctcgctggcatacgcctcaaccagacatccgtagatgatgccggtcagatagttcggcaccatattgtccattacttcatctgccgacgggtagaggctgatgttctcctgcatgactcccgacggtattttcgacatcgtgaaatctgcctttttcagcgggagcagctgtttcagcttcggctcctctttcatcgaattcaccatctcggtaaacaggataaaggcttcatccagctccccgttcagaaatccgtccaccattgtctcggaaatcaatctggcccggtgcatggtcggtttctgaaccgtatagcggaagctgccgtccatatccacgtccttcagcttgccgaaatactggcggccgactactcccagcacatacagcttcctgtgtcccggaagcttcaggcgttcctccgccatcttgataatgttatggttgtaggcgccgttcagccccttgtcggccgtgaccacgatcaggccgatcttccgatccccgggagctatctcagggcgctgatccagataccggttttccttttccgtatcgggaagatggcgcagcatacggtccagcgcgcgctgcacgccgaagaagtaaggctccgtatccgcaaggaccttcttcgccttcttcatcttagaggaggatatcagatacatggcattcgtaatcttcatcgtgtcctggatgctcttcatcctggtctggatctctttaatacttgccatttgtcatcacctgcctctgtcagctttatattcctctgccgctttcacaatcgcctgaatcagcgtctccggcagttccttcttctcttctatctcttttacaatctcaggatgaatctgttcaaaataccggagcatatcctcctggaattccttaatctgctttacctccacatccataaaaatcttatgggttgccgcacagagcgtgataacctgctcatggaggctgagaggatggtagagcggctgtttcagaagctccatcagcgattttccatattgaagctgttcttttgtcgcagcgtccaaatcggagctgaactgggtaaatacctccatctcacggtactgagccaaatcgatacggatacttcccgaggccttcttcatcgctttaaactgggccgcaccgccgacacgcgatactgacaggccgacgttaacggcaggcctcatacccgagaagaacaaatcgctctccaggaaaatctgtccgtcggtgatggagataacgttggtcggaatataagccgacacatcccccgcctgggtctcaatgatcggcagcgccgtgatggagcctccgcccagcgcgctgctcagacggctggaacgctcaagcagcctggaatgcaggtagaatacatctcccggatatgcctcacgtcccggtgaacgtccaagcagcagggataaggcacggtaagccaccgcatgctttgacaaatcgtcatatacaatcagcacatcttttcccttgtgcataaaatactcagccagcgcagtgcctgcatacggcgcaatgtactggagcggcgcacagtcgctggcagtggacgccatgaccgtcgtatattcaagcgcgccgtacttttcaaaggtggagaccagctttgcaatcgttgatgccttctggccgattgccacgtaaatacagataacgccttttcccttctggttcaggatcgtatctgtggctatggaggtcttgcctgtctgacggtcgccgataatcagctccctctggcctctgccgatggggaacatggagtcaatcgacaggattcccgtctccagaggctggttaaccgcctggcggtcaataatgccgggggcctcctcctcaaccggacggtagtcgtcggtcttaatctctccttttccgtcaatcggggcgccgagggcatcaattacacggccgatacaggcatctcccacggggacgccagctttttttccggttctggaagcgcgggttccttcgccaatctccgtatccttgccaaagaggatacagccgatgctgtcctgccggatatcctgcaccattcctttcaggccgcactcaaaggttatgacctcgccgtacatcgcatgatccatgccgtagattctggcaattccatcgcccacggagataacggtgcccgtctcctgctctttgcatatatcatcataattttcaatttcttctttcagtatggaaataatttcatctgaactcatcgaactcactcttctcacctccgtgtcaatttatgctgcagcctcttaaggcgtccgtccaggctgtagtcatattcaaaatctcctgccttcaggatgaagccgcccagcagggacgcatcctcccggatatcgaaggtcacgtcatttttccggtaccttctgcaaaggtatttcttcattccctgaagctgttcctcagaaggcggagtcacgcaggtaagctcggctctcaggatcccatcctgccgccttaagtattcctcgtagcattcaaaaatttcctcaatttgtcctgtcctttcatggaggcaggccaccttcagaaaatttctgacggactccggaaatacccggtcgattaccttctccttctgctccctgggaatcagcggattttcaagcatctgcttcaaagcgggcgtccctttaagcatcgcggcggcattcctcaaatcgtctgccgggacggacagctctgccagaacgcgggcgtaattaacggatgtctgtctcatgtccctcggcctcctttaaaaaacggtcatacagcagcgaatcttccgatccgtgcccggtatccccggtcatctttctggccgcgcttacagccagttcagcaatgcgggactggaggtcagccatggttttttctctttcattttcaatatttttctctgctttcctcatgatatctgccgcctgatctccggcttctttcagaatccgatccgattcctcctgcgcccgttttttcgcttcttcaatcaaacgtccggactcatttctggcatccctgagagccgcttcataacggttcttaagttcatctgcctgggcctcgctgtttctggcatttgacagcccgtcggatatcattgcctgtctcctatccataacggccgtaacaggcttaatcagaaattttttcaacaaaagacagaggataatcaggttaatgatttcaaagacaaggttccagtttaactgtaacacttctcccacctgcctttctcagttattttaagaataagataattacaagagcaataacaaaaccgtaaatagcggtagcctccgcaagggcgcatccaagaagaagagccttgctgatcttgctctcagcctccggctgtcttgcgattgcttccactgccttagaagttgcgataccgataccaatacctgctccaatacctgtaagtactgccactgctgctccgattgcgattaatgttgacataataattctctcctttaatttttgtattcgaatatttttttaatcaagctgttctttgatgaacagagcggtcaggaagacaaatacgtatgcctgaatcagaccgtcaaaaatgtcaaaataaaaactgaacggaatcggcacgataagcggggccaccagcttgattaattccattactacgaatgagcccagcacgttgccgaaaagccgcatgcacagagacacgggacggatggcaatctccataatgttgattggcagtataaacgccaccggttctgcaaaactcttaatgaatcccttcatgcctttcttatgaaatccggcatattcaattaccgcaatgctgatcactgccagcgcggccgtcacattcaaatccttcgtgggcggtgtgatacccgctatgccaatcagattggcaacgccgataaagagcgccgtcgaaatcagatacggaatgtaacctttcccttcttccccgaccagatccaggaagaaatcccttagaaagccaatggaagtttccagaaacaactggagtttccccggcttttccaccttcaggtttcttacaaagatgatggaaagaagaacaagaaccgccataatgaaccatgtcgccacaaccgactcgtatactgggattccgccgaatacgggtattgtgaatacgactttggcattcaattcttccatcagggcctttgaaagtgtgtccgtcttatatccctcccctataatagtatttgtgaagatgtttcagtaaccggcggccggatgcccccaggggcctgtcaccgtaaattacaaaaggccaatgccggtttcctgtaatcggattcccggaaaaggccctcaacttcttcgcttccccatattatggtacttcaggttaaaaaatgcaatatcaattgcaaagaaatttagttgtaaaatccaacaaaattaagcattttgtacaaatctccgtacaatccaaggctttttaacggcctgttaacaggaaatactgaaaaaaacgctgtttctgccataaataccacgatttatgaaaggaaacagcgcttcctgcgttaaaaaccaaaaaatgcattaattcctgctgtcagcccgtctccaagctggttcagggtttccgtcgaatggcttgacgccttatctcccagctcaatatcaatactcgggatggtggagaaggaggtctgtgtcagatccatctccatgctgccgccggagaaaattttatttccggcgtttttcagaccggttatcagggaatcccccagcttattatgctgctgccagttggacgccaccggctccatggccctgtaagaggcattgtttggaacgctcatataaaagcagcccttgttgctgctggtggaatcccagtgcagtgcgatatggcagtccgcattattattggcaattacggtcctggcaatattatcaagctggacgtcgtccgattcacgtatcatcaggacatcgtacccttccgccagcagacggtccttcaaaatcttcgccatctgaagcgtcactttgctctccgcggtaccgtcggcaaacgtcattccgccggaaaccgcaaccgccgtagtcgctccggcgccggtggttccgccagtcaccttgggcgttccgtccggatggcacagcgtcttgacgctgcttcctccctttgtcccgtggcccgcattgacgcagaccgtcttattctttctggaagcggcggtactcttgtacagaatcgcttttccactgttaatcttggaaaactcggcatacttatagtttgcggacaaaccgacctccgtacctgatacggcggaatcagagtttcccgaagccgccgcgccgctctgtcccgatgtattctgtgcagccgccttcttaaccggctgtgccgtactcaggtaggccgatgcaacatagcgcttctgtccgttcacaagcactgcggtccattcgccgtcggaaccgacccgctccagcttatctccataatagaaattcgttacaatattgccgtctttaatttcttctgatgaacggcatctcaatacgtcacagtttacataaacggtatctccggcaaaaaccgtctgggccgaacttgttaacataattgcggctgcaattgccgcccacttaattctcattaatattactctccttttaagttaccacgcatccttctgccgttactgtttagagcgtgcagatgatgggaatgaatttgcagacacactctagtataatgcatgcactaatcagttgcaagcgttagaaacttttcacattgattcgtccgtccttttcggctatactgagttcaatacatacggataaaatcaacctttcacctaaacctaaacctaaaggaatgttcccatgaaaaagaagaaaatcacttttacatttacgtcacatgtttcctccgcgttaataagcaacctgacccgggacttgcgtcttgtatttggcggcaccgtagaaataagcaccgtttacaccaatgaactgagagccggagatcaattgataagcgatgttttcctgataatgcgtcccggcaccatgcaggaattgcagcaccatatttccgaccccaaaaaggtggtcctcgttacccgcacggtatcggaagacgccatttaccgtctctatgacatacctaaaggaaaccgcgttctggtagttaacgattcacccgagaccaccagtgaaaccgtctccatgctctaccaattaggcgttacccacctgaacctgttaccctatcttcagaaaacggataatctggcagacatctgttttgccgtcaccccgggcgaacggcaccgtgttccggaatccattcccaatatcatcgacataggaaaccggcgccttgatatgcagacgtttttagatatgctgccgctcctgaatctgagttccggttccttcagccaggcccttctccggtatgcggacagtacgctcgagttacataccggaattaaaaaacggtatatacaaagttacgtgctcagcgaaaccctgacccagatcctgagtctgcagaactccgggattattgttaccgacgctgaatttcatatcagttactggaatacggaagccgagcatatcatggagaaacgccctctctttcagatggcactgtcctcctgttttcctgccgtgcatgcgcagaagatggcttcccccgacttttccgatgatcttatcagcctgaacggcaagccatttatggtaaagcggaatccgttctatacaatgggacagatttcaggctactgtcttacctttgattccgcatcgcagatacggaaaaacggcagcgagctgagccgcaagctgaaaagccagggacttttcgcccgataccattttgacgatatcatatatcgcgatccgcacatggagcgctgcatcgctctggcgaaaaaagtggcggaaagcgataacgtaattttaatcacaggtgaaaccggcaccggcaaagaactgtttgcccaggccatccataattactccccgcggaaaaataaaccctttgtagccgtcaactgcgccgcgctccccgaaagcctgctggaaagcgagcttttcggttacgaggaaggcgcctttaccggtgcaaagcgcgggggccgcatgggactctttgagcaggcggatgagggcactatctttctggatgagattggcgatatgccttacacgctccagtccaggcttctgcgcgttctccaggagcagcagattgtccgggtcggcggaggcagcgtcatcagcattaatgtccgtgtcctcgccgccacaaactgtaacctgagagaaatgatacacgaaaaacgttttcgcgaagacctctttttccgcctgaacgtttttccgctctgccttcccccgctggcagcaagaaaagccgatatcatcccccttttctgccgtctgggcggaatcgacgaaagtatgctggacgtttctgtccggaaacagctgctcaactactcctggccgggcaatgtacgcgaattaaaaaatgctgccgaatattataagctgatggaaaatctggaatgccttccgacagacatggagaatggcagcatcagttccactgcgaactgccggacagtccatgaactgcctaatcagattatgactctgatttactcccgcagccgggcggaacagacctccgggcggacaagtcttctgctggagctgaaagagagagggatttccatcagtgaaaacagaatggaacgcattttaagtaaattgcaggaatccggctatattgtcagaaacagggggcgtggcggcatctgccttacagaagcaggtactgcatttctggagtgcgcttccagttattccgcaataaatagtgaataaattgtgtaattatagttttttaacaccgtttattcctttatgcggttcttattatcaatcatgccgatacggaaaagtatcggcatattttatttttatccatatttttccattgtaaatagacacttccaacacttttcccctttttattttccctgtattttgatttttggcacgccgtttgctcttaataaagacaaacgcgtttattactaccaaattacaaatggaggaatttattatgaatgatctacccgttatagggctttcaacaggcagaatgtttttagaaggctccaatctcaccggaatggaaagagtgattgtcaatggcgattatatcggagcggttaagaaggccggcggtctttccgtaccggttccgcctgtatgcagcccggacgaaatacgccagtatgtcaaactgtgtgatggaatcattattacaggaggcctcgatgcagcccctatactttacggtgaaatgccccaccccggctgcggtatctttgatcttgacatggaccggacccacatcgaattaatccgcgaagtcatccgtcagggaaaaccccttctcggaatttgccgggggatgcagctcattaatgtggctttgggcggtacactgtatcaggatattccttcccagtgccccggctgcggcggccactcctatacctatatccgcggtgacgccgtccattcggtcacgctggacgaaggctctccgctgcacaggatatacggccggactgttctggatgtcaacagcatccaccaccaatccgtaaaagaatgcggaaaaggcgtagagatctgcgcccggtctgcagatggaatcgcagaaggcctttgtgttccgggacaaaagattttaggcatacaatggcatcccgaaatgcttctcacaaaatcagacgaatcgctctgcctctttgccgacttcatcgggcagtgccggtcataaatcatttacttatacagggggtatacacaaatggataacagcaaaacttttaaaacaccgtcttttggatattctgcctttgttctaatcgcattggcggcaagcactttttcaggcatgaagctcttcggcgcttcattaaacgtggttatgttccttaattggcttctcatgaccgctcttgcagccccgctgggcatcagctacaatcaccttgagaaaaaagccgcagagaatctttccggcattctgacaacactgttcattatctttgcaatcggagggttaacagggacttggatggcttcgggtaccgtaccggccatcatttatcacggaatgaatatcatgagcgcaaagttttttcttcccacatccctgcttctctgctccgtggtttctgtagccacaggcacttcctggggaacgctcggaaccatgggtgtagccttaatcggtattggggccggtcttggaattccggccggaatgacggcgggagcagccatctgcggcgcctggttcggcgataaaatctctcctctgtccgacactactaattttacggctgccatcgtcggcgctcctctcagcactcatattaagcatatgatgtacaccaccggaccatcctacgccgttaccctggcactcttttccgttcttggtctccgcatttcgcagagcagcgtattagatgcctcattgatccaggcgacccaggagggtatcgcctcgacttttaaactggggcttccggtcctgttcccaattatcgttgtgcttgttctgcttcttatgcgcaaaaatccgaccatggctctgctggccggttccctgacaggcattctcgtcgccatattttaccagggttctccgtctgcagcagcatttaactgtctttataacggtttcaacagggaatttgataatgctttccttacatctttacttaaccgcggcggaatcaccagcatgctcagcacctcgatgaccattatattctgtgtcggtatcggcggcatgatgaaggaaatgggagttatccacgtaattgtaaaacagcttgccaaactaatccgctccacaggaagtttgattctgatatcggaaattatcggatacatctcacagatgctttccggctcccattactttgcggatgttatgctgcagtccacaatgctggatatctacaaagaaaaacgcttaaaaccggaaaacctgtcgcgccttatggaagactgcaataccatcgggggaaccatgatcccgtggagttcgacggcgctttatatcgtagggactatcggcgtttcttttacagaatatctgccttacatctttttatgctatctgactcctctgatgggattaatctgcggtttcaccggatggggcattgcgcattataaagatgacgaaattataccggagtaataaagtacatgaaagaagggaatacaacatcatgagtcacaagaaagccattatactgacctgcggtattgctctgttatggagtctggccggatggaacatcaaaatgatcacctggagcccttacgcgatcgcggccgggcgcagcataatctccgtggttctgctgcttcccatggtggtgaaaggcaaaagtcttcatatcagccggaacatgatcggaggggctgtctgctatacaatttttaactactgttttatcatatcaaccaagctggcgacctcagccatcgctatcatgatgcaatacaccgcccctgtctatgttgcggtgctggcctggatttttttaaaggagcgtatcacgaaagccgatcttatcagcattgtctttatattcggcggaatgttcctcttctttacagacgaagccggcggaggcagtaccgcaggcaagattatcgctgtgtttaacggcatctcctttgccggaatctctattttcctgcgtctggaaaaggacggcgatcctaaactctgtatgtttttcggcaaccttctgtccggtatcgtcggtattccgtttattgcgacagccgggcctttagataccagcggatttttcttcctgctgctggccggtattttgtgcgcgctgacctacacgctctacgccgccgccagcaccggcctctccgctctcgagacggttctccttcccatcattgatccggtcatgaatccggtctgggtatttctttttctcggagaggctccgggaagcaagtccattatgggcgcggccgtcgtacttattgccgtgactgcacgcgtagtctacggtatacaggcagacgcagggaaagcccgtatggcctgaaacattaattttcccaccgccttcaatgtgaaggcggtgacctgtgcgctcagcgtgcaggttatcattgatgacggtgacctgtatgcggagcgtgcaggttatcgttttaccaggtattactgtgaaacttattctcaatgccggcaatcagttttcttaaccccgtggaaagaaatttatccttgtggtaaacgattttaaagcttcttttcaaaggaaaatcattgattgcaatctggttaacctcatcatggtgtctcaacaatgactttgacaatatagagactccctgacctgaggcaacgatattaataatggaatcagaactgtggcagatccatttttctacaatcggaatccctctgttctcggtgagatcggtaagaaattctctcgtaccggaaccttcttccctcagtacaaaagccttccccgccaaatccgtcaggtttatggaggacctgcccgcaaacggatgggttttcccgcagataaggaccatctcatcctcaaaaatatctttaaatatcacatccctcgtctttacgttcccctcaatcacggcaacatccagggtcccctctgaaattttccggatgatgttcatagagttatcaatataaacccggatattcacattcgggttttccgcctcatatccggtgatgatatcgctgagaaaaaaactgcctaccgtaagggatgcccctatatgaatgcactgctggctcgatgcatgatacagaaattgctccatctcatgataggtggcagtaatatgtctggcatattccagaaattccctgcctgtttccgttatgtaaagctttttggaaagccgctcaaataatttaacgtgatattctttttctatctgcataatggcatggctgaccgtgggctgtgtgatatacagctttctggaggctacccccatctgacccgtttcggccacggcaataaaaatctcaaaatcccggatcgtcataatcttttctcctttgtccgctccctgtaatacatagatattatgctatgagtttataacaagtttagcattttacgaatggcagggcaagctttataatagacttacatagaatagcgttactgttcacagccctgctgtaaaacgcagttctgtgaccagcaacatgcttcgcgatgcacagaacagtaacagaatagttatcatgtttcatcatgtttctgttcactggtacggtcagccatagcagccagcccgcagggcaaaaacaggaaaggaagtaaaaaaatgagaagcccaaaaacctatcagcttacaatagcagacataaataaactttttgccgtcctgaaagaaaagtacgctatttatgcgcctgtcagaatcccctccggagggagatattcgggacaagattccatcctctatcgggaggttgagcggtacgaggagatagagttccgcgagagatctacctatgcaatgaaagaggtgatcactccgattacccagactttattctattttaccgatgatgaattcagggagagcaagcttgaggactctagggatctgctcgtttttggaagggcctgcgacatcaatgcaataaagattcaggatcagatttactatgagaacggcggcgttgccgatcctttttatcaaaggagaagggaaaaggtaaagtttgcgctgatcgaatgtcaggaacaatttgacggctgtttctgctgcagcacaggctccaacgtcacggatatgcactccatcgcattttcttttggtgaggacggagcgtatatcgaggtaaaggatgactgcttcagcaaatattttgacggatgcggggagacagattatgaaatcacctttccggcagaaaataaattaaaggttgattttccggtgattgataatctcgatctggcaaacaaactgaagtcccatccgatgtgggatgaattcgacgccagatgtattgcctgcggagcctgtaccgtggcctgcagcacctgtacctgttttgaaaccaccgatattatttatacacagaacggaaaggccggagaaagaaggagaacctgctcctcctgtatggtggacggctttgaccgcatggccggaggcgcctgtttccgtcataaaatttccgaaaaataccgctataagatattacataaagtatacggacataacgcgagatttcataccggcccgatgtgtgtgggctgcggcaggtgttcggcaaggtgtccgcagttgatcggatatcccgaaacgctgaataagctgtcaaaggcaattaaagaaataaagcaagaggaggaagttagccatgctcaataatccggtaaagccacaggcacataaaatcatcgatatattaaaacagacggatgcggagtggaccttccgggtcgaaaatgaacttcccatcagacacggacaattcatgcagctctccctgcctaaaatcggtgaagctcccatctccatcagcggttttggcgacggatacgccgattttacaatccgaaaggtcggaaaggtgacggatgaacttttcaacctgaaaaaaggcagtaatatttttatcagaggatgttacggtaacggctggcccaccgaacagctgaaaggaaagaatgttgttatcatagccggaggaaccggagtatcaccggtcaagagcctgattaacctttagctcatttggcggcaattatgaatgtcttgtggtagggcctccggttatgatgaaatttgcagcaaaaagccttctggaacatcaggttcccgaggataaaatctggatgtcctttgagaggaaaatgtcctgcgccatcggcaaatgcggacattgcagaattgacgaaacttatgtctgtctggacgggcctgtatttaattatacggtcggaaaaaaactggtagattaggaggtaaattgctgtgagcgatataaatataggtaaattaagaaataactgtttccgccagtccaaggttgcaggagaattcatgttgcagcttcgcgtgccgggagcggtgatcgacgcgaaatggcttgagcttgtaagctacatatgtaatacctggggcaacggctcattccatctgggaatgcggcagaccttaaatgtgccgggcatcaaagccgaaaatattccggcggtaaatgaatacattcgtccttacctggacgcaatcgaacgcgatatgtgcgacgtgaagatggacacctccaacggctacccttttatcgggccgagaaacattatggcctgtatcggcggtatccattgcattaagggcaatgtcaatacgcaggaaatggcccataaaattgaaaaattagtctaccccaacccataccatatcaaggtatccatagcaggctgccccaacgactgcgccaaagggcatttccaggatttcggcattatcggctgcacaaagccgatctacgatatcgaccggtgtattggctgcggcgcctgtgtcgataaatgcaaaggagccgcaacccgcgtcctttcactgaatgataaaggaaaggttgacaaagacccttgctgctgtgtaggctgcggagaatgcgtcatcgcctgtcccgccggtgcatggagacggccggacaaagacttttataagattgtgatcggaggaagaacaggcaagcagtatcccagaatgggtaaaatgtttgccaactggctgaccgaagacagcgtactggcaatcatgagcaactggcccaaattctccgaatgggttctgggcggaaaaccggtctaccttcacggaggacatcttatcgacagagccggttaccagaagttcaaagattttatgcttgacggggtgaccctgaatcctgaggcctatattgcagaaaccatcaactgggccgagacggaatacagaagcaatatccatgtaaaaccgctggatcagcatgagacggtaaaatagagatttaactgaggtgtggaggtcgcgtccggaacggaccatgtccggtgtggtaagggggctggctgagtcttccgtccccgtgggaagttggttgtggagggggaatccggccggaatgaattgctgcggggaccgtttgcacttttcgaagcgcatagccgtgctaaattcatgagaaacctcattaagcacggatgggcttccatatcccctgcagaattgattccgcctctttccccccggtcagggtttcgccagggacggaagactcaggcgaaggttttcgcacaccggacatggtccgttccggccgctgattgtctccaaccttaaatggggagggccctgtcgcggccactacgtgtttctggcaaactgaaatcaaactttccgcaattatataaaaatggcattgaaggcatatcgaatttcccgttcacggaagctcttagtggccgcgacaaggtccgccccgcacttaacgcgtgagacattcagcggccgcaggccagtggacggggccgatacacttggcggagtctttcgtcccggcgaatacttgaccttggggcggaggggaagataaagtctgcggatgccgttgaaatccatcgctgattagcgaggtcctgtcgagcttagcagcgcgatgcatttcacagagcgggagcgtgctccgcagactttatcttcgcccgcagtcccaactcacaacaatcttcccccgggacgaaagactcataaaacaatcccaccaccccgtccgctggccgtaccggcggcgtccccacctgcttaactaaatctccacactaaaacaggcccggattttccatccgagcctgcctcttattttactcttcgcttaattcatcttcattcaggacaattctgtctgcctcgtcaagaatatccagatcgatatcatcgtcgtcagccagcataatctcatcctcttcttccatatcggtattcagcttgatggaacggtatctcttcataccagtaccggccggaatcagtttaccgataataacgttctccttcagtccaatcagatgatccactttaccgttgatagcggcctctgtaagaacttttgtcgtctcctggaaggaagcggccgataagaaggaatctgtagccagagaagcttttgtgataccgagcataacctgacggccgattgccggttctttgccttctgcaagcagagcctcgttcatatcgttgtaatccagaacgtccatggaggttcccggaagcacatcggaatctccgctctcctctatcttaatcttcttcagcatctggcgcacaatcatctcgatatgcttatcgttgatttctacaccctgaagacggtaaacgcgctgaacctcctgaatcatgtagtcctgaacggcgcggacacccttaatcttcagaatgtcatgcggattcacgctaccttcggtcagctcgtcaccggcctcaagtaaggaaccgtcctgaatcttgattctggaaccgtaaggaatcaggtaagtcttggaattaccagtctcattgtccgtgataataatctcacgtttcttctttgtatccttgatcgtcgcaattccgccgaactctgcaataattgcgagtcccttcggcttacgcgcctcgaaaagctcctcgacacggggaagaccctgtgtgatatcgccgccggcaacgccgcccgtatggaacgtacgcattgtaagctgtgtaccaggctcaccgatggactgggcagcgataataccaaccgcctcgccaacctgaaccggctggccggtcgccatgttggcgccgtagcacttcgcacacacaccgatatgggatttacaggttaagacggtacggattttcacgctgtccctgccctgtttcctaagcactgccataacggcagccgcacgcttcggcgtacacatatggtttgccttgacaatgacttcccctgtatcaggatctgtgatcgtctcggcgataaaacggcctgtgattcgctcttccagggcctcgattgtctcctggccgtccatgaagcctttaatctccatgaatgggatttctcttccttcacagcagtcctcttcacgtacgatcaggtcctgggaaacgtcaacaagacgtcttgtcaggtaacctgagtcggccgtacgaagcgccgtatcagacagacctttacgcgctccgtgggcagagatgaagtactccagtacgtcaaggccttcacggaagtttgacttgataggaagttcgatggtatggcctgttgtatctgccataagtccacgcatacctgccagctgtttaatctgtttatcggaaccacgggctccggagtcagccatcatatagatgttattatacttgtcaagtccggttaacaggtcatgagtcagctgatcatcggtagccttccatgtctcgataacctctttgtaacgctcctcctctgtgatgagaccacggcggaagttcttggcaatctggtcaacggtagactgggcatcttcaatcagctgctttttgctctcaggcacggtcatatcggaaattgatacggtcatggccgcccttgtggagtatttgtaaccaattgccttaatatcgtcaagtgtcacggcagtctgtgttgcgccgtgaatattgataactttctcaagaatctgttttaactgcttcttgcctacgtggaagtctacttccagctttaattcattctcttcaatgcttctgtccacaaaaccaagatcctgcggaataatctcattgaaaatgaagcggcctacggtggactcgatgatgccggtcttaaccgtaccgtcaggcattctcttctgcactctcacctttacttttgagtgaagggtaacttcgccgttctcataagcgagaattgcctcgttaacactcttgaaggccatgccttcgccctttgctcccggtctctcctgtgtcagatagtagataccgagtaccatatcctgtgaaggaacggctacaggaccgccgtcggacggttttaacaggttgttcggagacagtaaaaggaaacggcactctgcctgggcctctacggacagcggcagatgaacagccatctggtcaccgtcaaagtcggcgttgaacgcagtacaaacaaggggatgaagcttgattgccttgccttctaccagaatcggctcaaaggcctggataccaagtctgtgcagagtaggcgcgcggtttaacataaccggatgctctttaataacatcctccagcacatcccaaacttccggctggagacgctctaccatcttcttcgcgttcttgatattgtgtgcggttccgttggagacaagctctttcataacaaaaggcttgaacagctcaatcgccatctccttcggaaggccgcactggtaaatcttcagttccggtccaactacgataacggaacgtcccgaatagtcaactcgtttacccagaaggttctggcggaaacggccctgtttaccctttaacatatcggagagggattttaaagctctgtttccaggtcctgtcacaggcctgcctcgtctgccgttgtcgatgagtgcgtcgacagcctcctggagcatacgtttctcgttcctgacaatgatgtcgggagcgcccagttccagaagacgggcaagacggttgttacggttgataattcttctatataagtcgtttaagtcagatgttgcaaaacggccgccgtccagctgtaccataggacggatatccggaggaattaccggaactacggtcataatcatccactccggtttgttgccggaatttctgaaggcctcgaccacttccagcctcttgatgatacgggcgcgcttctggcctgtggcatctttgagctgttttctcaaatcctcagaatccttttccagattaatggcctgtaaaagttcctgaatggcctcggctcccattcctacacggaagttgccgtagccgtatttctccagctcatcacggtactccttctcggataatacctgtttgtactggaggcttgttttgcccggatccagtacgatataagaagcaaagtacagaaccttttccagtgttctcggagatatatcgagaatcagtcccatacggctggggattcccttgaagtaccagatatgggaaacaggcgccgcgagggcaatatggcccacgcgctccctgcggacactggctttcgttacttctacgccgcatcggtcacagattacacctttatatctgatttttttatatttaccacaatggcactcccaatccttgctcggcccgaagatcttctcacagaacagaccgtctttctccggctttaaggttctatagttgatggtctccggctttttcacctcgccgtgggaccactcaaggatcttctcaggggaggccaaaccaatcttgattgcgtcaaatgtcaatggctgataagtttcgtttgtctctggcatgaacagtactcccttctatcattaatcttcatcgtcagaataatcgtcgtcctgaatttcctctaaatcatcctgaatatctgcaaagtcgtcgctgtcatctgtctcttctacagttgctaattctccgtccttgaattcctgttcctggtagcctaagcttccaaaggactcgttctgggagtaatgtttgctgtcgctttcaaggatcgagcggatatctgtgtcgccatagtcgattgtttcagccagttccacctcggaaccgtcctccttcaggactctgacatcaagaccaagagactgaagctctttaagaagtaccttaaaggactccggaatacccggctcagggatattctctcccttgataatggcctcgtaagtcttcacacgtcctacaacatcatcggatttcactgtcaggatttcctgaagtgtataagatgcgccgtacgcctcgagtgcccaaacctccatctcgccgaaacgctggccgccgaactgagctttaccacccagaggctgctgtgtaacaagggagtatggtcctgtggaacgcgcatggatcttatcatctaccagatgatggagcttcaggtagtgcatgtgtccgatggttacagggctgtcaaaatattctccggtacggccgtcgcgcaggcggactttaccgtcgcgtccaagcggtacgcctttccagagcgctctgtgctccagatggcttcccagatattccatcagcttcggatctgctttatctctatatttttcttcaaattcttcccaggaggtgttgacataatcgtttgccagttccagggtatcctgaatatcaatctcgtttgctccgtcgaaaatcggtgtggaaacattgaatccaagcgctcttgcagcaaggcttaaatggatttccagaacctgtccgatattcatacgggaaggcacgcccagagggttgagtacaatatctaacggacgtccgtttggtaaaaacggcatatcctctacaggaagcacgcgggaaacaacacccttgttaccgtgacggccggccatcttgtcacctacggaaatcttacgtttctgtgcgatgtaaatgcggaccgtctcattcacgcccggtgaaagctcgtcgccgttctctcttgtgaatacttttgcatccacgatgataccgtaagctccgtgcggaacctttaaggaagtatcacgtacctctctcgccttctcaccgaagatggcgcgcagcagtctctcctctgcggtcagctctgtctctcccttaggagtaaccttgcccaccagaatatctccggcacgtacctcggctccgattcggataatacctctctcatccagatccttcagcgcatcttcaccgacacccggaacatctcttgtaatctcttccggtcccagcttcgtatcacgcgcttctgcttcatattcttcaatatgaacggaagtatatacatcttcctgcaccagtctctcgctcagaagaacggcatcctcgtagttataaccttcccaggtcatgaatccgattaacgggttcttacccagggcgatctcaccgttatccgtggacggaccgtctgcgataacttctccaacctccacgtgatcgcctttgtagacaatcggtttctggttatagcagttgctctggttgcttctcttaaatttggtaagatggtaaacatctctgtttccatcggaatctcttttgataatgatctcgttggatgcggagcgctcaactacgcctgcattctttgcaaccatgcagacaccggagtcaaccgccgcttttccttcgatacccgtaccaacgactgctgcctctgtcttcagaagcggaacggcctgacgctgcatgttggaacccatcagcgcacggttggcatcgtcgttctccaggaaaggaatcatggacgtagctacagagaacaccatcttaggagaaacgtccatcagatcgattctcttcttctggaactctgatgtctcttcgcggaaacgtccggaaacattattgtgaatgaagtggccttcatcgtccaacggctcattcgcctgtgctacaacaaagttatcctcttcatcagccgtcagatatacaacctcttccgtaacgaccgggttgtgcgggtcggatttatctaccacgcggtacggcgcttccacaaagccgtactggtttactcttgcataggttgcaagggagttgataagaccgatgttcggaccctcgggagtctcgatcgggcacatacggccgtaatgtgtatagtgaacatctcgtacctcgaatccggcacggtctctggaaagaccgccaggtccaagggcggaaagacgtctcttatgcgtcagctctgccagagggttattctgatccataaactgggacagctgggagcttccgaagaactccttaacggctgccgtcacaggcttgatattgattaaggactgggcagatacaccttccatatcctgagtagtcattctctcacgaaccacacgctccatcctggacagaccgatacggtactggttctgtaaaagctctccgacggcgcggatacgtctgttgcccagatggtcgatatcatcctgtgttccgattccgccctcaagatgcatattatagttgatggaagcgataatatcttccttcgtaatatgttttggaatcagatcatggatatctctcttgatgacttcctttaattcttcatctgatccagcttctgccagaataccttcaagcaccgggtagtatactaactctgtaacaccgacttcctccggatcgaaatccacataggaagcaagatctaccatcatgttggacagaaccttatggttctttctctcaccctgaatccatacgtatgggatggctgcgttctggatatcggttgcaagctgtttatcaacctccgtacctttttccgcaagaatttcaccggttgacatgtcaacgacatcctcagccagcgtatgtcccgcgatacggtttttaaaatgaagtttcttattaaatttataacggcctacctttgcaagatcatatcttctggggtcgaagaacatgctgttcaataagctctctgcactgtcaacggaaagaggctcacccggacgaatcttcttatataattccagaaggccatcctggtaattgctggaaggatctttttcaaagctcttctccagcttcagctcttcaccgaaaagttcgataatctctgcattggtgccataacctaatgcacggatcagtacggttacgggaacttttcttgttctgtccacgcggacatagaagatgtcgttggaatccgtctcgtactccagccaggctccgcggttcgggataaccgtacagctgtacaactccgtaccaatcttgtcatgtgctattccgtaatagataccaggggaacgtactaactggctgacgattacacgctcagcgccattaattacaaaggaaccggtgtcagtcataagcggcagatcgcccatgaaaatctcatgttcattaatctcgtctttatccttattgcaaagtctaacctttacttttaaaggagcggcataagtagcatcacgttccttacactcttcgatcgtatatttgatgtcatctttacacagtgtaaaatctacaaagtccaaactcaagtgccctgcaaaatctgcaatcggggagatgtcagcaaacacttcacgaagtccctcatcgaggaaccactgataagagtttttctgaatctcaatcaagttcggcatttccagaacttctttttgtcttgagaaggtcattcttacacctttaccggctttcaccggacgcatcctgcttttctccattcgacgtttcacccctgttttctttctatggtttaattttgggcatacttcggccttatgggcctatgttaccacaatagtgcatttttcatcttatcatgaataaatttgtgtgtcaaggaaatttttgccctgttttcctatatttatgccgttttttaataaccccgctaaacagcgatggattccaaaggcatccgcagactatatcttctcctccgtcccaatggaatctgatgaagctgtttgagtatatttgttggaaatttgatacatgatatagatttgatgtctataggaaactgagcggaattaaagccggatgaatatcaccggatttaattccgctccgaatgaattttaagacacgctctagtcttacacaaattctgtgaaatagcccgccatcaatgtaatggcttcatccaatgtgctttcctttgggaggaatttttcgttatgcaggggatattcactttcacagcccatgaaaaaatacatcgacggcagtttttggctgtaaaatgagaagtcctccccaatcagactcggggatatatccgtatggaccgactcagcgcccagaatccggccggccgcatttataaatttttccgtaattcttcggttgttatctaccaccgcataaccgtcttcgatagtaacgccggttgttcccctgtatgcggccgcgatatttccggccagttcctttattcttttatggacaaattgacggatatcaggattcatgctccttatcgttccttctatcagaacctgatcacatatgatgttgtaccggcctgaggtccggatggagccgatcgatatcagtacggtctcaaaagggctgatttccctccttattttatgttccaccgcattaataatctccgccgcaatggatatggcatccacccctttctgtggttcggccgcatgggctttcttgcctgtcacccggatcagcagcttatccgacgacgccatgatcggtcccggctttactgcgatttctccgactttaagctccggccacatatgtaatccataaaattcctccacgccaaactgctcaaacagcccctggccgataacggcttttgctccccccgtcgggttgcattcctccgccggctggaagacaatcagaatatttaccctgagcagctgcctgaacttccataaaatcacggcaagccccgccgccacagacgcgtgcatgtcatggccgcatgcatgcatgacgcccggattgacagatttaaaatctatttcatttttttcttcaatcggcagggcatcgatatccgcacggaatccggccgtatgttcctttccgcaatcgatccatgcatatccgccagtcatatgcccaaaattacagaatggaaccccatattcttccagaaactgtttaatccgggaggtagtagccgtctccccgtagccctgttccggatttgcatgaatctcacgccgcagttttctgaccttcggcaatagttcccgcaaggtttccctgatcttcggattacttaaagatgctctcatctacttcaattcccaggcctggcttctgggggacttccacataaccgtcctttaccttaaaatcttctataataatatcatgctgatgcagcggccctcccagcagcatatcattgggaatatctgcgtttaccgtacttgccacaaaatgtatactggcggcggagccgattcccacctccagattacttccggccgtcgccaaaagaccttctgcttccaaacacgccgcaatcttctttgccatcgtcagtcctcccaccttgcctactttgatatttacgctgtcgcaggcctgttcacggattaccacgcctgccgaatggaaatcagagaccgactcatctgccataatcggggttttcaggcgttcacgcagcattctcatgccctggatatcccaccgtttgaccggctgctctatgctttccaggccgaattcttccagtcttcggaagataccgagcgctgtactgtaattatatccctgattcgcatccaggcgcagcgggaaaccgtctcccagctcatcgcggatgcgctttaccagacgataatccacttccggtgattttccaaccttcacctttaatacacggtagccctccttcagtttttccctcgcctcctcaatcgaggcatccaaatcctgcattccgactacccagctcagggcggctttttccctgtacagtcctcccaagagccggtatgcgggaagttccgttatctttcccatgatgtcgtataatgccatgtctatcgccgactttgccgcatagttgccgtaaatagcagagttcattttttcgtgtattaaatccgtggaaaatacgtccatgccaatcacggcgtctttcagataccggttgacggcgacctccatcgtatatcccgtttctcccataaatgccggagacggagcagcctcgccaaacccaacaattccatcctccgttgtaatcctgacgatggcatgggctcttgttgtctgctcatacagagatattttccactgtttttttaaaggcagttccagtacctttacctccacattttttataattcctctgttcattatttactccttaaattgttttctggattttttgcttttctagagcgtgtttgaaaattgctttctgtcagctgtgcgtcacactttgtgggcgatttggcccgaatgagcgcggcgtagtgggctacggtaagcgaattcgggccaaatatgccgcgaagtggggcgtgcagatgatgggaatgaattttcaaacaggctctaaacctttactgcatttctctgattaattcactgtttattaattttccaatctcctggttcagccagattccttcccggttatcggcaagctcatcggtaagtacaattgctattatctccctgtcatcggtgcatataattccggcatcgtgttcgacccccggcaaatcccccgtcttatgcgcgaatcgcacgcctccctccatcagggcgggcagcttattattgcactgctgccggaaaaggatatcgagaatatctcccctgaagctgctttctaagattgccttcataagcttctgcatgtctccggcgcttgtataattgtcaagccctctctcctttgcctgtgaatccatcattttccgctgcaggaccgtatgcttcattcccatggcctgaagttcagaattgatctgagacatcccgattctatcgattaataggttggcggctatgttgtcgctgagcgtgatcatcagaaccgccaaatcgcgcacagcaggattaagcccgtctcccaaatctttgaggattccaaatccgcctatgcggctgtctttttccagctctattctctcatccagggcaatctgattttcttttgccattcgaaaaagcgctgacaaaaccggaaccttgatcaggcttgcggcgggaaacacctcatcacggttgatttctactgcctcgcctgtctttaaatcctcgattacgatcgcctttttcccctctatccttgaacagagatttaaaacattcaacttaagcttatccgtatccacccccgtatcacctctttccggcggcaagctcaccgtagctttccggtctgcggtcccggaacatatgaatcatatcccttatctcctttacttccgagagctcgatggaacctgttatgattccttcctcatcgtttccctcagcgataacattcccccatggatcgatgatgatggaatggccgcagtaagttcccatgggactttccccgacacggttgcaggctgcaacaaacatctggttttcgatcgccctggcaatcagcagcgtcctccagtgacttacgcggggatttggaaaattcgaagtgacgatgagcagctccgctccccttagcgcgtaaatgcgtgataattcgcagaaacggatatcatagcaaatcatgaatccgacacggcccagctccgtatcgtaaacctccgtttttgttccgtgaagatatggcacatcctcatccatatcactgtacagatgcattttgctgtaatcaccgactatctccccttcccggttaatgagaaacgtagtatttctcatcccgtcttctgatcggatacccacggaaccggcgacgatccacaccgaatactgtttggcacattctctcaaaacggtaaccgacggcccgtctatctgttcaatatgctcttccatatggtggaacatctcatctgaaaaaccggaggaccagtcttccggcagcacgattacatcgggcctcggcactttctccatcgcatcagcgatcatttctttgacatgcgcggcgttatattcgaaatcacaaaatttaatgtctgtttgaagcaatgctaaatgaattcccatatattttaccttttcccttctattcttgtaacggttcagacgtctgaactgttacctattcttctctgcatatggccgtccggtttattacggagtccgctccgctccccaaagagttctccgcgtgtcttttgacgggatttaccccgcgtacattacagcccgaatcagcacatagacaaaagtaacaatagtgataacccagccgtttttcaacattgccttgatatcctttgacctggccagccccatattgccgaccatatccacagtcggcgtgacaaagaatgtgatctggcatcccacaagaatcaccaaagcccagatatccattttaacggacagaagtactaccaggggtaaaaacagatcgtggatcatttttgcctgcgcaacgccggctcccgatattccaaatacgccgattgcggtgctgagcatcaggaatgccaccacgcctcccgcgtcgatgagaggctgcatatatccggcgatcgcatcaaaggctcccgatgccgccacatagttgagaaacgggtcgaacaggataaacataaagaacatccaaaacattttagaagctccctgcacgagggttgtcagcccctctgcaattcccatccccgatgcaaacgccgtgaccagggaagccgtcagcattaccacaattgcataagatgccccggccttaaccgctactccgtaaaccagcatgacaagcatcgtgattccgaatgcccaggtagcccgtttgatctccggagtcacctggaaatcttccgaaactgcttcgtccccgctgtaagacacctttccttccgtaagcttctgtgtccggcaggcaacaaaaaatgtacatacccatatgataagacctaacggcagtcctgccgttttcatatactggctgtaattcagcccggtcagtcccatgacggttgctacaggaggcacaaacggaccaatctgaagcccggccgcccccgcgccatgcaggattatccccagtgtgctgggcgtaatcccaagactggccataatcggaatcagaatcggcgcaataattgcattcgaacccgacagtgttccaagcatggagaccagcagggtcgatgtgcacatggcaataaaaattgcctgtttctttgatttaagctttgcttttcctattaccagatgcacaatgttatgagcgactttcgtcctggtcaggacttctcccagaccggagccaagaacgatgataaagccgatcagcgacaagaaagaactgagagaattctgtagaacggtaccaaaaccgcttacactctctcccgtcatgacagcgcctaaaatcacgcaaatcaggacggacaggttcatgtcttttcccttcatcattaagataatgtagagaacaagaggcaaaaagcccaagatgggcggtaaacccaaaatcattacaacatctcctttcactaccccgcctctttttcgttactattcacggccctgctgaaaaacgcagttccgtgaaccgtaacacgctccgcgatgcacagaaactgcaaaaaatgcagtttcgcgccgtgaaactcgggattttcgtgcaaaatacgcacgaaaacacctcgcggaatgggccgtgaatagtaactctttttccacagtattaccgtggtaaagctggttcatattcagttttatttataactttttcagggattattaccagttactgttcgcactccgcttcctggcggggtgtgaacagtaacgattatcactaagaaattctaagacagtaccgcccggcttcttgcaatctgcaggattttagcgtatactaaaggaaggggggagctccttaaagaatgtctgaatgggccaacatgcagcgctttaaaagttccttcctttttgtttagaatctattctgaaaaatgttatatctgattcattacaaatataagccgtattcaagcgctatctcatcctggcgctccagcttcttcaatgtattgtctttatccctccttcctgccgcagtaatcagggcgtttgccaccgtcattgagttgacaaaagaataggtatccaccgcatgctttgccagaagaaccgttgtggccttcaatgcaattggtgaagaatggctgtccgtaaccgctatgaccgggcatccttttttatttaaataggagacaatattatatgtagccctggtatatcgttcatagctgattgcaatgagacagtcttctttctcaatgtactgcagtttattcgaaatatctccggttccttctgtcagcagttcaacatgctccataaattccttcagcatgaaatacagataatatgcaacactgaaagacgagcgggcggcagttatatagagtttacggcagctcgttatcaaatcaacggattgctgaaaatttcttttcaggtcttcactgttcagtgtctccagtgagttaatattcagacgtatcatccggcttaatatatcttcctccccctcctctgtaatcgaatgctttaattcacgcatcggtaccacgtccttgcgaatcaaatccgctgcgcttttctggaattgtgaataaccgttaaaccccagctccctcgtaaagcgggtgatactggccagactcacctgcgtcttttccccaagctccgcaatcgatagaaatgggatcatatgcacattatctttgataaaatccgccagttttttctgcgtctttgtcaatgccgaataattttcattgatgatgctaagtacgttattatccatgtaaaacctccatagcttcattatagaaatctccattgtgaaagtcaatagaaatgtaaaatatttttcattttttattgtttttgataatttattttcaatctcaactctcaccaaataccaatcaccgcctataacgataacctgttttaaatataaatcccatatttccttatcctatactggaggctctggcgctgcagcccaagttttttggctgcctgtgtcacattaccgcagcagcggcgcgccggggaagcaatgagaaagctgcagtatattattgcaatcgacatcatggtctcccttcaggcaatcgatatgttaaagccattgaggcagggaaaagcgacggcaaagctccatgatttcatccgggaaaaagtagcttttgccgaccaggaccgtttcttttatcccgatattgaatatatttacacgcttgtcaaggatggtaccctgattcagctcatcgaagaagaaacaggagctattaacctttaagatacacactcatactgctgacttcatacgtacaagacaaggatggagagggcgcccgatggaatttacggcctgcgggatgccctctttattccgtgtgaacatgacattccgttgtaacagttcagacagcatgaactgttacattctgttcttttccggcccccggtttttacgcttttccttgcctttttatctatctgatgctataatagcgacaagtgcggttatttttttgtggtgctgatggacagtggtaaattgcaagggaaaggggctgttttcctgtcatttttatagttaacgccatatccgccgctatcatttacggaggtatttatatgcagacatttctgaacgtagtgctcatcatcctggttattgcactcattgcactggcagtactttattatttcggaaggaagatggagaagcgtcaggctgagcagcagtccatgatggaagctgcaaaacagacggtttcaattctcgttattgataagaagaaactgaaagtcaaagagtcgggtctccctaagatggttattgatcagactccatggtatatgagaagggccaagcttcctattgtgaaggcaaaggtcggcccgaaggttttaactcttattgcagatgacaaggcgtttttacagctcccggttaagacagaagccaaggttgtaatcagcgggctctacataacggatgttaagagcgtccgcggtggcataccgccgcttcctaagaagaagggattctttgcacggtttaagaaagataagagtgggaaaaagtaattagagtgataattgaatttagtataggaaaaaaactgccgggacaggtgaactgttaacggcagtttttttgcttttccttcaccgcttcatacgccagcagatgcagtttatctcccttttcatgaaaccccagccccagattcgcgccggaatccgttgaaaagccgcagtcaaactgtgagagaagcttatagtttgaacggagctctttccggaaaaaacggctgctgaaattattccggctggcttcaggataacttctcaataaatttttcatggaacgctcccctccatcaaaataaaagtatacccccgcagcaagtccgccgtctttcagataggcgctcatatagtccggccagaaatcatcatggtaaaaattatgttcattcgtcgcaaaaaaatcaacggttatatccacacacttctttttaatgggaggggcagtccctgcatcggcaatatacagaatatcaagtcctcttccgcacctgtcaatgacttctttataagccagcagcgactctggaaatttatccgtgacaatcagctccgtaccgtccaataaaagctccgtatgattatgaaggaaaaaccaggcattcacatagctttcccacattactttaccagatgttcccgcctttgtcaggcattcgcccagccagtgataagaccgctcgaacaggctgagcgtagccgacggaagatcccggtacagctccctgattgtgtcaggtttatcgtaaaaactggtattgcggttttgcgtcagtaatattccgttctgtatccgcgcagaatatccgcagcggcagttcatctccgcctcaaaaatatatcggctgtccatcgaggcattttgcgccctcaactctcctccgcatacagggcaggccagcagccgcagcattttaagcggtacgccggtatccactatttcacaatctccggctccaagcaagctcagcgaagagcgcagcaactgctgcgcatgtgtcagagtttcaattttctcttccagcgccctatcctgctccgcgaacattttccgtaattcatccctgtcttcctgcggcattaaacctgatattcttctaagggacaggattctgtggatcacttccaatggaaattccatctgtttcaatgtcagcagccattcgagatcactcagggttttctcgtcaaaaacatactgtccacggctgaccggagggaccagcaggccgtgcttaatataataatagatgcttgttacgggaactgcaaattttttcgctgcctgtcctatcttcatgcgtacctccttgcagatatagaaatgaaatacccgaaactcccggctcatactcagataactctctctggctgaatactatccctctctcttgtttttcaaaataacatggatttagacctaagtcaaggtttttacaaaaaaggctgaattttaaatattgacatgaactccagtcttttatttatactaataacagttcaacatgaaattgacagaatacaacagaccgattttattatggcaggtctgctcaactgcacggcggattcagcaaaggaatcatcgttagagcgtgtttgaaaattgctttctgacatgctctaggaaattagaacagaatgccggttttgattaacaggctattactgagatttatttttaaggaggatataccgatatggaatttttaaaaaaatcagttttgcgtacaattaaggaaaacagagacttagtagaaaatgtaactgagattatacgaaatgtccgtgacaacggcgatgatgccatccttcattacaacataaaatttgacggcaacggccgcaggaatttccgtgtgagcgctgaggagatagcgtctgcctatgcctctgtgccgcaggaatgcctggatgatatgcggcaggcggcaaagcacattgaagcctttgcccaggctcaaaaaaactgcctgttaccgctgaacggattttcaacgataccgggggcttctctgggacacaaaatcattccggtaaattcctgctgctgctatgttccgggcggcggttaccctcttttttcatcggccctgatgttaattataccggcaaaaactgccggtgttaaacgtgtggctgcctgcgcaccggctgcaaaaggaaaggactgtatcaacccgctgaccctggcagctatggatattgccggtgcagacgagatctacgtcatgggcggtgcgcacagtattgctgcattttcctatggaacccgtcaggtggctccggttgatatgattgtcggcccgggcaaccaatatgtggcagaggccaaacgtcaatgttacggccaaattggaattgattttatagccggtcccagcgaagtcctggttcttgcagataagacggccaatccggctatcatcgcagccgatcttctggctcaatcggaacatgataaactcgccaaaggaattctggtgacaacagacagacagcttggactcgatgtaatcgaggccgtccgggccgaactgggcactctggaaacggcagatattgcctgttcgtcctgggagtcctacggtgaagtcatatttgctgaaaatctgaaggaggccgtctctcttgccaatgaatatgcgccggaacatcttgaagttattcttgataatgccgatgaggtaacggaacagctctgtaattatggctccctctttatcggacaggaaacgggggaggtgttcggagattatgcttccggaacaaaccatacacttcctactattcgggcgtcgcgctatacaggcggcgtatggaccggcaccttcctgaaagtatgcacctaccagcattacggccgccctgcaatgaagcagactgcacctctcgtatcgcggatggcaagaagggaaggactcatcggacatgccagagccgctgagctgcggaacgagcttttataggaatggaaccggaatagcctgaaaggtactttcagcatcagtattgcattaatatcagaaagaaaggagttaataatgcgccaatttacagacctggaaaatcatttgttggaactggttgacacggaaggagccatcgcatttttacaaaggctggtacagagcgacagccaaaacccgccgggaaatgagatgcagacagccttgattatcagaaaaaagcttgatgaaatcggactaatgaccgaagttcaggaagtggagccgggacgtttcaatgtaatcggacttctggccggggaaagcgaggagcagctattatttaacggccacatggatacagtaaaaactggtgatcctaatacgtggaccaagccgccgctggggggattaatagaaaatggcaggctttacggcagaggcgcctgcgatatgaaatccggccttgctgcgatgattttcgcgattgaagcattagtaaaatgcggtatcacaccacataaaagtatactgttcacggccgtaatcgatgaagaagtgttttttaaaggcacccgggcactgattgacacaggaaaactaaagcactgcaccagagcttatgtcagtgagcctacctctctctgcatcgcaaccagcctgcagggagccgccgaatttacagccagaacctatggaaaagccgcccattgcggaatggctgaaaatggtatcaatgcaattattcccatggccgaatttgcaactgaactgaacaaactgaatgacaggctgaagggaaaaggtgcgcttctcggatttccggtcaaccccagcctgaatgtgggctccataaagggcggaatcgatatcactctcgtccccgactactgtgaaatgaatttcgaccgtcaggtatttcccggtgaggatatgcagcaggcaattgacgaaatccacgagatattcaaacaggtatgttccaaatatgggacgagaaatgagctgacctgtaaccagtatttcaattactggaaagtcgataaagctcatcctgttgcccagactgccgttcactgccacgaaatggtcactggaagtaagcccgatgataccctgttccgcgcctatgcagaagtggaaatgattgcacagcagggaattcccggtatcatctacggtccgggcagcatactgcaggctcaccggccggatgaatatgtagagcttgatgaatttatcacggcacttaaaacttatgcattgattggacttgattttatacgttgattgatatgtttgtaccagaggttgagccaacaaaagtataccatacgaagtacgcaaggagggccaaatatgagtaatcagaaaacagaaaaacttgggttaaaaaaatcattatcttacggcatgggggccatcggagaagggatcggatataacttcttttacagctattttatcttttttatgattaatattgccggggttaatccggccgtcgcagggactgtttcccttattgcagtattctgggatgccgtcactgaccctattatcggttctatgtccgaccggtgccgcagcaaaaggggggcgcagaacaccgtttatcaaatacggctctatattcctcggaatctccctggcgcttatgttcatcaatatcgacctgcctgccggtgcaaaggtagtgtattatatcctaatcaatattgcctactggacgttcctgacttcggctgtaattccccatatagcattgggttccgaactgacggatgactttgaggaaagaactacgctgcgcacctgcgccaatttcctgatgaatatcggcatgcttatcgcaatcagcggctcactcatgattgtacaattttttgcaaaaatatttggcagcgaaagtctcggatggacggcgaccggagtactgtttgcagtgataatcgttttcgtgtataatttctgctgcttttcagtacggaactttgagcctgaaaacccaaatcttgcagaggggtatgtaccggaaaaattgtcattatcgtctgttttcagtagctatcttcaagccctcaaggttaaaccatttaacaaactgctgattattactttctgtgttaactttgcagtcggcgtcggctccagcctgatgatttttctttacacttacgtcttccgctacagtgagaacaaaacctctttcatgttactcatcacaacgcttttcctgctgcttacaaccgttttagccggtgtgtttgcaaacaaattcggcaaaaagcagatgatgatcggcggaatgatatgctataccgcctgttatctgatcatggcagtacttccggccggtgactttaccgcttacctttacattttgttttacggtatcggaaatgccacttactggacattgatttattccatgtcttatgatacggcattgattgagaagttcaaatccggcaattctccggacggcctctatacttcgatgatcggatttttcatgaaggccggaagcgcaatcggaatgtggattaccggcattgtgctcagtgcaatcggcttcaacgccgaagctgccgaacaggccgcggatacaatagctaatcttaagctggcatttggcatcataccggccgttatcctcgctgttgccgtaatagcagctattgcttattcgctgacgaaggaaaagtatgcgctgctgctgactgcggcagaggcgaaggaaaatggtgtggaatatcgggttgaggggttggagaaggtgctgtgaggtgatgtgggctgcactgggagctttaaaaatttattatgactggattgagtgactgtaaaaagatgctgttctgtatcgtttgggaaaattatgccgacatgacgtagattatcgcaaagatagcgaaccttcaaactgaggtaagaataccttactcagtttggaggtttattttagatggaaggttgctttattagataataaataatgtccctgactgtagaaatagcacatgatgcatgtacagttctttttactctaatttagtgacacatttcaaagtatccggcgctttttcctcggtcggtacctgatagatggctctaagagccgcacagttaattaaaattatgagaatgtgaaactttttctgtaaaattaactacgataaggtccttttatgataaaataaatatcattaggagggccttttactatggcaagacaaaagaaaccggttcacagagttgaaatgacagaaggaaaacgaaatattatccgacagcttctcgaggaatatgatattgagacagcagaagatattcaggatgctcttaaagatctcctgggtggtaccattaaggaaatgatggaggctgaaatggatgagcacctcggatatgaaaaatccgagcgttctgacaatgacgattatcgcaacgggtataagcgcaagcaggtcaacagtcgctacggttctatggcaatcgaagtaccgcaggatcggaaatctacctttgaaccacagattgtaaaaaagcgtcaaaaagatatttctgacattgaccagaagattatttccatgtatgcaaaaggaatgactacacgccaaatctcggaaacaatagaggatatctatgggttcgaaacatcagaaagttttatttctgatgtgaccgataaggtacttccgcagattgaagactggcagaatcggccattagacgaggtatatccaatcctttacatcgatgccatccactattctgtacgggataatggggtgatccgtaaacttgccgcttatgtcatactgggcattaattcggaaggcagaaaggaagtcctaacgattacaattggtgacaacgaaagtgcgaaatactggctttctgtcttgaatgaactgaaaaatcgtggtgttaaggatatcctgattatttgtgcagatggtcttactggtatcaaagaagcgatttctgcggcatttcccaaaacagaatatcagaggtgcatggtccatcaggtaagaaacaccttaaaatatgtccccgataaagacaggaaagcctttgctgctgatttaaaaacgatttatcaggctgctgatgaacagaaagctttggcagccttagagcgtgtaaccgaaaaatggacacctaaatatccgaattccatgaagcgctggaaagataactgggatgctatttccccgatttttaagttttcagctgctgtccggaaggtcatttacacgacgaatgcgatagaatcgctgaattccacctatcggaagctgaatcgccagaggagtgtatttccaagcgatacagctctgctaaaagcgctgtatctggctacttttgaagctacgaaaaaatggaccaccaccatccgggactgggcgcatgtctatggagaactgagtatcatgtatgaaggacggcttccagaataaagaaaaataagcggaaagacaggcggcttgccgcctgctcttgacatacatggaagtacctgttatatataaaacaagggtgaaaaacctgatttagaagtttcccacccttcattatcatagaagaatcttatttacagaaattttctcatactctcaaaattataagcacctcctatgattttttactacatttattcacctgttttctagtatatctgctatacgtctgctggcaaatccatcaccatacgggttgctggcatgactcattttatcgtatatcttttcattttccagcagctgcttaaatgattcataaattttatcttcctgtgttccaaccagctttaaagttccagcttcgattccttctggacgttctgtcgtatcccgcattaccagaacaggctttcctaaagaaggcgcctcctcctgtattcctcctgaatccgtaagaatcaaataagaattggcaaggaaattatgaaaatctattacatccagcggttctataattcggattcgatcatctcctcccaaaatctcattagcagtctcccttacaattggattcatatgtatcggatagattgccttaacatccgaatgttcctcacagactttccgaatagctcggaacatatttttcataggttcaccaagattttccctacggtgggcagtaatcataattaaacggctcccctttgcccactccaactgttcatggctataatcctgacacaccgttgttttaagtgcatcaattgccgtattgcctgtcacatatattgtttcaggctttcttccctcattaattaaattaagcctcgacatttctgtcggggcaaagttatatgacgatataatgctaactgcctgccggttaaattcctccggataaggtgaatatacgttgtatgtacgaagaccagcttccacgtggccaactggtatctgtaaatagaaacaggccaatgctgtaacaaatgtcgtagaggtatctccgtgaaccagtacaacatctggtttctctgtctctaataccacctttattctgttcaggatatttgttgttacgtcaaaaagcgtctggcgttctttcatgattgacaagtcgtgatctggtaccacattgaaagtttctaggacttggtccagcatttggcggtgttgcccagtaacacagacaaccgtacgcatatcttttctagtttttagttcgtttacaagagggcacatttttatagcttcggggcgagtgccaaagacgagtaaaatttttttcattttatctatcatcactttcatattaaagtaattttttaatacatattcctataactgttctatggccgcatatactctagaggtgtttttttgatcaaaaaactcaaaaaaattctctactctttccaaatacaattttctattattgaactgtccataatcactattataaatttcactaataaattctacaacttgattacagcttgttagtacaggcccaaatccatctttttcatatgaaaaatacccctcctcatattgttcttttctatattgctctgcatcaaattgataatataccagcggcttttttaaataagcaaaatcaaatgaaatgctagaataatctgttatcaaaaagttagaatttctaagtaaagattggatatcatatttttcataatcagctataataatagatggattttctttgaataaatgtctataaacctgtaagtcaggatgcaaataaaaaatgattttaaaatcattaagtctacaaaactcttttaatttctcattagataaaagttctgaatactttttataataatctgaatctgcaaaaatctgatcagaattatttacatccttattatgtgaaaaatcgagccagtacctccatgttggaagtactaatatctgtttatatttcttggaattatctattaaattatcaaatcgacaaaaacctgataatacagtatcatttaaagaatagccaaatttagttataatgaattcccgttctcttttcgcagctgttataaataaatcaattttattgttttttttataaagaaaaaatgcattattacaagttataccatgttgtaaaaatatatttttaaaattataaatattataaagtaataagttaaaacaaatatgaccatttggcattccattacctatatgcgcacttatattcttattacatgcccaaaacaataaatgatgttttaaactgccaaatttaataatatttcctaatgattctattttataatagtctgctgatttaaaattaataggataataagtctttttatgtggatagtttatacgaataaatttaaatagccaatagccattatctcgcgcttcattttctcgttcagaaattagccatatgtcaggattaaaaatcttatatatttttcccggaaaaaaagtaataataatttttactaatgaaatatagtcttttattgtcatttttttaattttagcccaaaattgaatcatgaaaattctccctaaaattatcctaaattttatttataaaaaattttctatacaataaagatgctcctaaaaaacaaactgctaaagaacaccaaaactgtgcagtaaataaaaatgtggcaaaacccatagctgtagatcgtggaagaaataataatccttcaatgctaagaagaactacactaaattgtaaaacaccttttttagaaaactctgtaacatatatcatacaaaatccaatgataaagctaaataatgctacccctatatatttataatccgcaaataattctaataaatagcaagagcctactccgtgcccttgtaaataccaatcgcctaataatacataggaaaggtgatgcgccatattatttcctaaagttgctctaagaacactatttccattacccaggtccaacgttccccaaattttttgtccaattgttccatacaaaaaatagtcaataaaacttccgaaggtatagctgatcgttctattttgtggtagttcagataaaacccccaaaccactgcaaaggtaagaaaaagaaattcccaaattataaaataaatctaaaatagaatttataattcctgtataatgtacccctttcccttctcttatgtacatataaagtcccataaacactaatgcgaagggacctaatattgccattgatattctttcaaacttcccaatccatttttcttttttatcccacaaatctcgtaatacataataaataaatactgttataatgttcagcattaagggatttctcgccccaaccactaagtctggtactgcagtaaaaatatataaaatcaccggcaaaaaagtcttttttttacttggaaatgtagctagaaaaaaaataaagctatatttgttaagtgttgaaataacataaacgatataaggtaacttactacggaaaattgtgtagaattcaacataatcatgatttttaataaaatttattttttctacacttattaatccgacaaaaatcaaagaaaaataaaatgtaattaatgaggtaatctgtaaacccttattgaaatttaatttactattattttctacgtacaactttctctttgtattaaaatgactaccatacaaagcacctaaccataaaaaaaatagagatataaaaatcactaccaaacccaaaaggatattagcttttggtgtatagttatttaatatatgctcaatccaattttcttttcgtattaaactaattaagggcctagataataaaaatgagaatattgtgcaattaaaaaaaaagaagaagactcgtcgcccaaaatcttccagagaatataatatattattcagccacaacaaagtaatacttaagagaaacaaattcatatattcagaattaaataaagaaaccattaatataacgcaagagcctaggatacaaaaacttcttaagaaaaaacttatttttcgatacactaatcaccacctccttgtttatttatttaatgctattaatttcactcttttcagaaattgtctcatctgttcaggttcgaatatagcatttcctacagtataaaaaaacatggatgtaatacctataaccatggctcgtaagaaccattctttataggaatgtggttcatgtaattgtaaactataatacaatagaatataaactataaagaataagctatttctaacaaaacggcacataaatttttgcatgatattttttattaaattcttttttacatagatataaatatttattgaactaaaaacaaatgcacaaagcgttccaattaatactccctcaagcccaaaaggtcgaatcaacaacagagcaatcacaatatttataactgcttccataactgcccttttttgcgtttgagtataatgaccggctgcagtaataacagtaagcgctgggactcggatattttgcattaaaccaataaatgtaaacaacatagccactgatggtcttatatagtttacatcaactatatcactcgtataaattttaacaaatgatatataaagaaggcccatacatgtataacaaataaacaataatatttgaaagataaattcataattagaataagcttctattaatgttttttcatcttttcgagatataacttcaccaaaccctgcgcttagtgcagttgtaaaagagtttattactgatatcactaaattagaaaccatttgataaattgtgtatacactgacttctaatagggaatctagtttcaatcctacagttaatattacaatattcgtattgttcaatacgacgcctgcaagttgatgaattaatgctgaccaatgttgcgacaatgcagtatctttgggttgtaccttaagatttaagtatgggtactttttcttcacataataatatatgtaaatcgaacgcattataaatactgctgtagccacaaattttacttctgttataccaacacctttttgtattaaatcaacacatacaattgtatttattatagttccaaatatttgtgtagcagttacaacgtaccccttttgatctgccattaagagcactctatatttacctaaaaaaaggtaatctattagattactggatgctaatattaatataattagtctggtagtaattggacttacctgttcttttattataaaaggataaaaaacagcaaatagtgcaacaagaaaagtatatagaatacccgaccttaaataaaatttatttgttgcagctagaatactatttatctcttcataacacttagtagtcagtggagcgtacaagcctactattgaagcagcacttattcccgcttcaacaagcattaaatatgccataaattgcgttatagatgataccatgccattcatggctgatccatatgccagcaaataaaacctaggcaataaaagaccacttaccgctgttacaatctgtaataatatattagctgctatattttttagagcttgttttcccctcacattttctcctcctggaagaacaggttcaccatttttaggttattttaaatttatctgttaattttaagagtaatgcagtaaaacgtggacctaacatttttttaatgttttgattatacctatttttagaagatatccatgagcccgcaaaatgatgaatggcataggtattatctgtaatttgtaattccaaagtccgattatttttaggacaaaaatattcggtcggataaaaagtaaaatttaaaatggtttgctttttattatttaagagcaatccattttgaattgcaaatgcagtgattaactctacatttgtagtcaaatcaattttcccattttctaatacaaaccgcttttcatcatatttatctaaaatttctttgataaaaggatgacctttttcgcatgccattagcccggtaggaactttgtcaggcatttcaaaaccagagaatccctgttcttcaagaaagcaatctaaaggtttcgttacttcaacgtccgtatccatatatataccaccataataatatagagcatatagtcgaacataatctgttataaaggcccattttttatgttcatacgcttcttttgtatatcgtaacttgttaatatcaaaattatcttcattccactctattattttgtattgtggacaatattttttccaactttctataaattctttagtttcttctggtaatggattttttccaaaccaacagtagtgtataattttgggtatcatcttctatgcttctttctatcctatatttttgtttgtctggcaaattttttaaagaaccaacctctaacactgttaggcagtattagttgtacaatgactcttattaatatattctccaaaaacgttctttttccgataatcttgtatttcaataagtatttctgtataaaaaattcactcttaaaataaacttgaccaccacgtcttttatacatttccttcccaacacgcacatatactaaatttcctgccaaattagcaaacttcgccccttcttgaaacaatctaatccacagataataatcctcattatataaaagatgcttataatttcctgcattaagtacagcactttttttgaacataactgtaacatggttaaatgggcaacgtcgtttcataaactttataatatcggcatgttttgtaggaacagttctcattcctacgacattatttatatcattcacaaactcaacaatacctccgcctactacacttaaatcgttttccaatttaaatttttcaatctgtagttgaaatctttcgggaatgcaaatatcatcactgtccattcttgcaatatattcatatgtacaattatttacagcaatattcaatgcacgtcccagtcctacattttggggtagctgtattatttttatagctattttgttatataactcttttttaaattgatctattatatttaaaatttcttctgaaactagaccatctatgactaagaccacttcatcaggcaataacgtttgaccgtaaacgcttttcagcgcctgctcaaaatatttagggttgtcttttttgtacacacttattgcaacagatattttatactcgtgcactttctatacactctctttccaagcattcattattaacctagctctttcgttatatatctcatatacttctttattgatcttttttgtccttacgagataatctcccagatcttctgcggtttccattcccactgttgatatgttctctcttttcagcaccttgataatagtttttacaactatggataaatccgttcttaatgaaatatgattgacatacttcaaatcccagcttaacttctcctcccaagaaatcttatttctcccattcacctgggctaatcccgtcaatcctggaagtacctcatgacgtttcctctgcttcgccgtcataaaaaccatatctctcaccaactgtggccgcggccccaccacactcatatcccctttaagaatattaaacaattccggcagttcatctaagctggttgcccgtaatttttttccaaactccgtcagtctcacttcgtcaggcagcaaatttccatcttgatcacgctcatccgtcatactgcggaacttatacatctcaaaaattctttcatttttacccggccttttttgtttaaaaatcaccgggcttcctagctttacacgcacaagaaaagctgtcaccagcatcaccggtgacagcacaataattccagccgctgccataataatgtccaacagcctctttatatatttccgatacatccctgcatctcctattttctaaagcagagtctctgcttaagtaagctaaattccctatcttcctatctaaacaacgattttactatctgagtgacccgttccatatcctcatccgtatttttcacatcactgggcaaacatacccctctgtcaaaaatatcccggccaattgacttaccattgaaactctccacctgtataaaatcattttcctgataaaccggctgtaaatccatcggtttccaaatcggcctgctctcaatattttccttttccagcgcctccataatttcaagcggagagattcctctctggatacattccggttccagggtaatacatgacagccagttattagcctcaccgtcgggattcaatggattcatccgaatctctggtatatccgcgaaagcctcctgatatctttggtaaatatgctgctttttctccttatatttatctaacgtcagcagctgcccgcggccgattccggcgacaatattactcatccggtaattgtatcctatctctttatgttcataatgccttgctgcttctctggcctgtgttgcccagaatctggcctttattatgtctttttcactatccgacaccagcattccgccgccggaggtcgtgattatcttatttccgttaaatgaaaaaatgccgtactttccaaaagtaccgcatcctcttcctttatatgtactgccgagcgcttccgccgcatcttcaatcaacggcacgccatgtttctcacagatacccataatctcatccattttagcgggtgtaccgtaaagatgggcaagcaatacggcttttgtttcaggatatttccggaagccttcttccagcgcttcgggcgacatattccacgtatccttttccgcgtcgataaaaaccagctttcctccttcataggtaacagggttacaggttgcggcaaatgtaagagaagatgaaagtaccacatcccctggccctattcctgccagcttgactgcaagatgcagtgctgccgtcccggcgcttaatgctgctgcatgctttgagccgacatatgcagcaagttcattttcaaattcgtcaacattttttccaaggggcgccacccagtttgtatcaaaggcctcctggatatactccatttcatgcccattcattgtcggactggataaaaatattcttttttgcttttccatccttcaccctctcttccttaataccatcgcattcgttttatgaatctatttttattatttcattcatagaaaaaaggccccctgcatgttgcatgccggtcagcctttcgtatccatttattttaatatatttgattcgttatttcttctcgtgcgggcttctcatccaccagttcaatcccaagcttcacatccaccattctccccgcaaatggcatttgaaccgtaacctcacgcttatgcaggtccacttttgtcacatatccttccagccccttcagaggcccttcccggacaactactttctttcctctgtcaattccatcaactttgccgctgtactctccccccacaacctggactttggataccctggtcacatggcggcagtccccaattgctttaatcctctgctcttcatcctctgaaagggacaaaaaaagaaagttcccgtcctgcagaactttcgtcaatctgccaacctgtttcagccgcctgtacagctcctccgcgttccctgaatcggcaaacacatatcccggaaataaaagttcttcaacctgctgccagcgccccttaaatttcttcacccgctctttcttcggtataaagcactccctcaggctgtcatcacagagcgtcagttgctttttgatcagctccgccgtcttctcctcctgtcccccctggacttgtattacataccacatatctgtcgtttttccttcccgcacaagcggaagcgtccagagctgttgtttcatttcaggtaaaatagggtaagcttcgccatttgcacgcaatgcaaaatacaaattgcgcgtgcaactgccgttgttatcccctattaccatatagcccggaatctgtgtgccaatgcttcacgtcatctgcctataatcctgtattctcaaaaagatgtatcttcattaatataaccgcattcgtgctgaacatccatgctgaaactgcatcctgcatttcaatttcaaatgctgttcaaacgtatgtcgcttaacagatatattaagcgacatctttcgatacgatattatacaatcttctgagtttcgtaaattataacaccaattttatgggaggtcaatattccccctcccattctaacagtaagttattcctaatattttcttattttttcttaaatcccagtatttaccgcttctttccctacaagacccggctattcccctagccggaaatccgccaacgccttggaccgcacatctatcacaatgtggcactgggaaaccatctcatagttcacgtccagagaataatcaatttccacgcggagctgatccggtttttcttccaataaaatattatctgtattcaccccaaccataatctgcccgaagggcatggcgtaacagcagacatttgttttctctttctcgaatatcatatgggaacgggcgcttccgctcttgattatctctacgatatcctccctgatcttaatcgtgttacggattgcaccttccacgccgtcaatcagttcatcgtagattacgtaatgtttaccgtttttacagaaataactcccggccgttattacggatacatcatcgctgtccccgtcaaccatatgcgctccgctgatactcacaagtacatctttcgtcatatcagtactcctcaatattaatcttttttgtctccctgacttctcttggaagaatcgacgttgcaaaattagtaaacttctcagccaaatcgcttacaaagaactggtactgctctctggtatcttccacgccttctgactttgcgccgcgggtcatccccttctccttaagcagccccttcagctccactgccgtctcataagccggattcaccagcgttacatcatcgcccatcaggcgcttaaatgtggagcgcagaagcggataatgggtacatcccattacaagcgtatcaatatatttccctttcaggcacgcaaggtaacgggatgcaatctcatccgtcaccgaatcgtgaagcagtccctcttccaccagcgggacgaaaagcgggcaaggtttacctgtcacttcgatatcccctctaagttgtttcatctcctccgaatatactccgctgcggatcgtggcctcggtcccgatgattccaatctttccattcctggtggcctccacggccgccctggaaccggccgaaatcacgccgataatcggaatatccaggctcttctccaccgcctcaagggcgcaggctgatgccgtattgcaggcgattacaatcgccttcacctcttttgtctgcaggaaacggatgatctgctgcgaataacgaatcactgtctcctttgatttattcccataaggcaccctggccgtatctccaaagtatacaattctctcgtcaggcatctgacgcataatctcccgcattacggtaagaccgccaacccctgaatcgaagacaccaatcggcgcatttctgtccatctgattcctccatctgattcctatacttgtatcacccatgtattctgcacttgtaccgtatgcttacacactgcgcttaactcaatgccttaactcgcacgccgattaataccgcttcattccatgctcgatcagcttcccaaccagctctgtcttgctgattccggccgcctcaaacaacatcgggtacatgctgatcgccgtaaatccgggcattgtgtttatttcattaaatacaacgtcgccgtccttcgtgacaaagaaatcgacccgtgcaagcccatagccgtctaccgctttaaatatctccacggcggcacggcgcactctctcggcgctgtcacccggaagctccggatttacaaccgtcctggactctgcattaaaatatttcgcctcaaaatcatagaattgtgcggcggccaggacctcgccgacgccggatgcaatcaccggctcttttccgttcccgaatacggcgcattcaatctcatggccgacaatcgtctcctctaccagaatctttctgtcatggcgtgcagcctcggtaagaccctctgtgagctgttccctgttttcagccttggatacgcccctggaggagcctgcgttggacggtttaataaatacaggataagcaaaccgtgcttccacccgtttcaccgcttcggccattccctctgtacctgcaatctcctctttcatcactggctcataggctgcctgccgcactcctaccctgtcggcaataatctttgtaaaaaacttatccatcgatacggcggaagccagaactccgcagccgacatatgggagcttcgccagctcaaaaagtccctggattgtaccatcttccccataaagaccatgcagcacgggaaatgcaccatctaccttgattttctttattccggccccgtctatgacaatgacacttttttccgttgcatccggcgagagaacggcctgaaccgtaccatctctccagctttcatcctgaatcgcctccaccgaatctaccagcagccagtgtccctcttccgtaattcccacgataagtacatcatatgtatctctgtctatattattaatcacatttactgccgacatgcaggagacaatatgctctgatgactgtccgccgaaaataacgagaattctcttttttatcatgatttaatctgcctttctatcggatataattttaaactgtttagattataacacagctgtcaatacttggggtaagtaagataaaaatatgaaataaattgtaagaaataaagcagtaactggaataaagcagctctgaaatatatcagccatggaggtttaccaatgtcacatccacacattacatattatatgaataaattatcaaaagggacttcaagaaaggcggctctacttataagcgccgccctctccctcactctgcttgtttcagtaccgctggtcctgaaccaggccagaaaggcggaggagagcctgtcaagcggactggctccccagattctgcgcttccatgttctggctaacagcaacagtaaggaagaccaggatctgaagctggaagtaaaacagcttcttattgacaccatgtacgaagatttagacggccgggagctgtctaaggatgaattgatttcctacgtaacagaacacaaagaagagctggaacaaaccgccgaatcatttatgcgttccgaaggctatgcctatccggccgatatccggattgaacgctgctattttccgaccaaagtctacggtgacgtcacgttcccctgcggggactacgatgcggtccgggttcttttgggaagcggacaaggaaacaactggtggtgcgtcctttatccgccgttgtgtttttcccagtcttctgtctgcgaggttcccgactcctcaaagcaggaactgaaaaaccttcttacagacaatgattaccgcgatctgatgaagagcagacgggttgtttttaatgataccaaacaaaaaacgcagacggaaacttccgaaaaagttaccgtccgcgtccgtttccgccttgcagaattactatcgcgagactaaatttaaaatatatatctgtgccggctacccgtctgttcaggtaccgcgctgaccggacgaaccaaacaggctctagttcccggtggaaagcatgcccttcagagcccagtcatacgtctccatcgcctggaacagggatatctccgctgtctggcggtcgatctgtttgcccaggaaggccgcctgctcctgcaggtagtccagctggctcgccatgccaagctggtactttctttccatggcattcatcgccgttgtctcggtagccagggcggcttctgccagctcaaacgccgtttttttctggagaatatcattatataaattcaccatggaggcggcaaccgtctcctccagatttttgatcgtgcgctccatattctttttatcggtagagccctcggtcatattcttaagaatctttttattataatttaaatcgtaattgttctgaagagcagtctgcttatccacatccggattcattgccgcaatcctgttcatatctgcccctggcacttccctgatatcagggtctgcgttgaactgccagcctgtggccagacagagactgtgttttacggaatccaaagaggtacgggtctgggtataggtggattgaatggactgcacgtttttcttggccgtcagtatatccatctgtgtcgccatcccaagagaggcacgcgtctcggtagagcgctggactgcttccataatctctatatttttctgaattacgtccagactgcttttcatctggttataagaggcgaacatggtttgcaccgacataatcagaccgttctgcgttttctgatatttgagttttctggactcgtcgtcgtcgtactggctgtcggcggaaatattctgcttcattgcactgttatccatcatcgccgcgccaagatacatggcattgtaggaggacattaagctgtttacactgttaatgcctgcctgcttaagcactgcgtccgcctgttctttggacatgttctgcagggaattggctaaatccagaagggaatcagccgtgtccctcatgtcttccgcctgactggtcatatcgtcggcagcgtctttcaaatcctgtcttacggtttccgcatcgtcctttgtcctggaatctttataggaaacctgattattcatgtaggtgggattgtattcctccaccagcatctgaagctcatcatattccatcacattgtcccgcagccgggcccaggtcgcctcgtcatgggcaaattccgggttctctgccattacctgcagaggtgacgtgacagtcatggctgccgctgtcaaaatcgaaagaactaagaccttcttatcgtgtttcatctttactctccttctgcattactattaggacatgatcaggccttttaccgcccagtcatacttttccatggctgaaaatagttctatgtctgcaacttctttattcgacttcgatgtaagaaattctgcctgggcgctcaggtactcaagttttcccatcattcccagagaatatttccggtcggccgcctgcattttctgctccgcagccgcatattcggagagagccgcctcgtaggactgccgtttggaaatgacagtattataaagggcctgaagcgtggacgccacatcctgttccgactgtgccacattcctcttcttcacgtttctcgcagaggaaccggaggcggaagctcctttgagcgactggagatcgtagttggctcctatggccgaccggagatcgttctccggattcatctggtcgatccgcgacagatcggaggccggtaccggccgtatttccggagcggagtcatggttccatcccgtcagtatgagcagattctgcctcatattgtcaataccgtatttaagctgggcagcgccgctttccgcctgttttaaggtttcctgggccgtctggatgtcctggaccgatttcattcccatggccgccatcctgtttgccgcatccagattggcctgggccaattctatctgcttgttcatcagctcctgcttggcaatcgtctcactgtactggatcatcagttgctgggtggaagcaaccagtttgcttttcgtctgtctgagtgtcttcttgtaagagcttcccagctcctcgtttgtcagcttctgggcctgtttgcgcagctcctttgccgactccttgtagctgtcataaagctccctcgtggtctcattaaggccgtcagaacgaagctcataagcttcatccatcaaatccgacgcaccttctctcaattctcttgccgcgtccagcgactgggtgctattcaccagagtcgaattaagctgcttgtaattcgtgttgtagttttcaatcctctggtcaatgtcgttgtaatccagaaccgtatcctcggcaccggctcccgccccgtttatgtaagtcgtctttcctgaaggccctgcggccgcataagcggggactgtcagagatatcgctgccagggcagccagggcggccgcagttatctgtttccgtctttttttcattctattttctcacctccgcagtttaactgctactgttcacaggttgtattccgcgaggtgttttcgtgcgaattatgcacgaaaatcccgagttgcacggcgcgaaacggcgctttttgccgtttctgtgcatcgcgaagcgtgttattgttcgcagcacgccgtcttttgtcggggtgtgaacaataacgtttaactgaccacggtttctatccgtatgcggctgtccctgccgggtacagccgcatacttcctatattttgttacaaaaccattttaccacacttctgccattaatccacatccaattcttccctgtgtcctctgttcatcagtgtgtaataaatcgggagcatcagcagggacaatgatgtcgaagccagcaggccgcccacgtttacaagcgccatcccctgcatcatctctccgctgtcgccgattccaagcgccatcggaatcatggctactatcgttgtcagcgttgtcatcaggataggacggagccttgtggctcccgcttcgatcagggccgtgtcgcggtccatattgctcctgtactggtttgccgtatcaacataaagaataccgttgtttacaaccgtaccgaccagcatcaaaaatcccaaaagggacggcatactgatggtagcgtcagccaggaacatcagtccgaaggaaccaatcaagctgaacggaatcgtcgtcataaccatgatagagaacttcggtgattcaaactgggcagccataactacgaagatcaggaagacggcaaggccgattgctcccgcaagtgcgccgaactcttccgccatcgcttcatccatactgttctgagccctggtaatgctctcagacatgttgggaagcactgcttctttgtaaattgttgtctctattgcatcctgatcgtcctttgcaatgcccttcacgaaatcaccggtaatcgtaacctgatattctttgtcagccctgacgatattctgaggactgtctttaaaataaatgtcggcaatatcggtaagtgccacggaaccgccggtcgcggtatcgagtacgattcccttcacctggtcaatcgtatcatattcgccgtccggatactcgaccatgacgctgatttcgccgccgtttacatcgagagtcgtagcttccttgccgctgagcatcaggttgaccgtacctcccacctgcgcgggagtcaggccttctgccgctgccttcagcgggtccacttcaatctttataaccggagccgagttttccagggaagaatgaatccttgttacctcaggacggttcttaagcgcctggacaatcttatcggacgccgccttcagctcatcgtactgggtactctggaggatatactcaacgccttcgtttccgcctcccatcatactcatggcactctgggaagacaatgtgatattcgtatcaggaatcgaggtcagcaccggcctccattcatcaaccactttctttgtggaacgttttctgtcgtccttcaggtatgctgtcagcgaagcggaagagcctcccgagatactgagtccgctgcttccgtaggaaagcatgtaggattccacatcctcgtcatttgccacatagtcttcaacctctgataaaatctcgttggctttctcaattcccagacccggccttaagccgacggtgattgatatggtaccctggtcatttgccggcatcagctccgtcttgagctgggtcgccaggaaaagggaaataaccagcagagctactgttgtaaacataaccgttttcttcttaggaagaagcgacttcatgatacccctgtatccgttctgcatctttgtcacaagaccggaaagcggagccgtagtccgttccttcggccggtacatcatgtagcataacggaacgatcgtcatagccgaaatgagtgacgcaaccatacagaacacaatcgtgaagccaaggggtttaaacatctgtcccgtcatacccgacaggaacgccagcggaaggaatacgacgcaggtggtagccgttgagccgataatcgactggattacgatgctgctgccttccagggccgctttatggaattcgttaaagccttttccttttgtggaacggaaacagctctccagtactacaatcgagttgtcaaccatcataccgacacccagcaccaggcttcccaaagtgataacattgagtgagaatcccatgaccctcatcataaccagggccgccagaatagacaccggtatggacgttccgacaatcagggacgcctttaaatctccgaagaacaggaaaataaccaccattgatacgataattgccgcaatcatcgtctgcaatacactgattaatgagccgttaatctgatcgctgttgtcatttactacaacgatttgaaggtccggatttacttcagttaatcgtgaaattgttctgttaactgctttggacacatccatggccgagcttttctgctgtttctttatgcccagcgcaaccgtatcctggccgttgtaccggccgataccggcggcatcctttaacgtggagtagacatttgccacatcctcaagataaattgtattgccgtttccgaccgtaatcgggatccgtttcaggctctccatatcatcaaattcaacgcctgttgtaacggaaagactctggctccccacctcggtgcttccggccggataagccagattggcggaggcgactgccgtaaccagggaattcatgctgagatgatactgctttagcttctccgggatcacttcaacccggatatactcctcacgtccgccgctgatgtcaacgctggccacggaggatatcttctccagctccgggacgatcttctcatctacatagttataaagattatctgctttatcattgtttaccgccagatacatcgtcgcctggtcattaatgttgaactccatgatagtcggagtctgcacatcatccggcaggctgctctgcatggcatccgtctttttctttaagtcggaatatgccttatccatatccgtgccgtattcatactgcagcagcaccatggacatgttttcatttgaatagctgtttacggatttaattccgttcaaagtgccgatctcatcttcaatcggcttggtaaccagttcatcgacgtcctccgggttagctcccggataaacggtaaatacgactaccatcggcatttccatctcgggagtcagctccagtttcgatgaaaatatggatgaaataccaaatacgatcaggcagagaactgccagaaccgtcgtaaccggacgtttcaggacgcttcttgttaatcccatgtgagtgcctccttattccgcttctgcttctgtcgtgttttccgccgtaccggatgatgcgccgtctgttgtgctttctccggcagttccggatgcgcctaggatttctacctgcgagccttcaaacagctcggaactccaggtgacaattatgtcatcctccgtgctgagtcctcccgtaatctctgtcttctccgcatcgtaaatgcctacttccacaggcacttcatgtactgcgttatccttatatgtataaaccattgcttttccgccctgataataaatagcatctgtcggaatcatcataacgttttcagctttgctggatgtaacataaagcttaacctgcgccccggttgccagggaatccgcatcttcaagggatgctttaattttgaaaaggcctgtggacgcatctaccatggaactgatttcagtaatcacaccgtgataatcactgccgtttttctcaatccggatcacatcaccggtgttgagtccgtctacaacccgttccgtcacattaaacgacaccgcctttgtcccttcccctgaaataacacaaagtacgttagactgggccacattatcgtgtacttccacgttaaagctttccacaaggccgctgattggcgccgtaatggtgctgaactcaatctggttatcataagccagctttgccgcatcatactggagctttgccatctttgcgctgctctgcacctgctcaaactgctgctgtgagatgtcgccgctctgaagcagaacgctcatcctctgcaggtttgtattggcatcctgaagggaaacggcagccgtatccagattgatttttgccccgtccacctgttttgtatcaatatggagcagctcctgcccttcctccacataatctcccgccttcacatagacgtcggtcacctcgcctgccgccttcggaatgatgtagacaatatctgatggctcgaccgtaccggtcaggcctgtatacaattcaatatttccaatctccggcttctgtatagagaccaccggaacagaagccgctgcaacttcctccttcggtttcaaaaatctgggcaagataattgctgctgccgccacaatcactaccgctgtaatgattacttttttcttcttcatgttgtcctcctgtttcgtctgctttcttcgcttcaaaattctatgattatttttctatgattaaatatattgcagcctttttattctatccgtctttcatgaatttccggcccgtccttctgaaccgttcctgcatatcccattcttcaggatttccagctttgtggcaaaacgggatttgattgtatccacaggcacttcgtcaaaatagtctttgatttccatcgcaatacttaacatggcaagctggaaaaaacagtggaacacctcataatcttccaccatcatcactttcttgtccgtgttttcaaaaatccacctctctatctcttcattcttgtggccgtatgtatcattcatcctttttgaaaagccctttaagatctcctctgaacccgtatgatacatcacatttttaatgaatttaaactggcctttaccggaacaaaattcaatcgtcctgtccagcagcgcttccagcataacccagatatttcctccagacgtgatcagggcctccctgcaaaaatctctcagtctgttctggctgtcctcgaaaatgcacgccagcagatcccatttatcctcaaaatatgtataaaaactccctctggatatatccgcctctttaataatctggttaattgataccttatcgagaggcacccgcgcaaattccttcacggcggcgctgcagatgctccgtttcttctcttccggaagtctgtaaaaccgttctgtaggcataagtcttcctccccccctgttatttactcttatcttcagtatggctgccaaggcccctccgatattctactgtgtaccggtgtaaaaatatcgcaaaaaggtgacaggctgtcattattatagtgacagcctgtcaccttgtcaagagacttataaaaatttaatataattttaactttatttgtaattcagacaggggactgctgagatctgattggagatttagttaagcaggtgaggacgccgccggtacggccagcggacggggtggttggggagtgtatatgagtctttcgtcccgggggtttggcatcgctggctggagaaggagatactgtggttttttttcgcagggcggagccggagagaatgatatccggctggactgcttcttcgagggatagctctaagacagaggaaggcaaagccccccggggttacggacaaattcgctccgaactccgaatgagttcgaagctcaagttgtcccggattttgcccttgtagggcaaaatccgcccggcgcgctttgtctccctctgcctaagagctatcatctctcgggcgaacgtccttccggatatcattctctccttctccgccggaagatgtcggcagtatctccttctcccggaaggttttcgccgggacgaaagactccgccaagtgtatcggccccgtccactggcctgcggccgctgagtgtctcacgcgttaagtgcggggggcggaccttgtcgaggccactcagtgcaacgtgtgtgggaaatacgatatgccttcaatacgccttatataaaattgtggaggatttgatatcggcctgccggaaacacgtagtggtcgcgacagggtcctccccatttaaggttagagacaatcagcgcccggaacggactatgtccggtgccacgaaaacctccgcctgagtcttccgtccccggcaaaaacctgaacgggggaagtaggcggaatcaattctggaggggatatggaagcccatccgtgcttaatgaggtttctcacgaatttagcacggctatgcgcttcgaaaagtgcaaacggtccccgtaagaattcattccggccggattcccctcacgacaaccttcaaccagggacggaagactcagccagccccccccaccacaccggacatggtccgttccggacgcgtcctcctaacctccgttaaatctccatatgttttagtaacagcgccccgcctaaactgttacctttatttagcacagtaagattctgctcaattccggactgtttttccagccagtacttctttatagtctttataattctcctccagcagagtcggggtgtccagtccataaggacatttagccctgcattgtccgcaatggacgcagtcctcgatttttttcatcttcgcctggccttcctccgtgagaaaatcatccgggggcatccgtcttaagaggagcgacattctggcacagagattaatctcgatgccggacggacacggcagacagtaaccgcaggcccggcagaatgagcctgccagctctttcctgtctttttcaattacggcatttcgctcatccgtaagctccggaggattatcgatatagctgatgaattcatccagctccgcctccctctgcacgccccagatgggaagtacattttcatgagagagcatccatgcataaatcaccgctgaatccgtaataaggcccccggaaagccccttcattgcgataaagcccatattctgcttacggcaggactcagccagggcaagttcgcgctctgtggacagatagttaaacggaaactggagcgtatcatagagtcccgattccaccgcctcctccgccacagccatcctgtggttcgtaatgccgatatatcgtatcatgccctgttccctggctttaagcatggcttcatagagcccgctgccgtctcccggcttcggacagaatgccgggttgtggaactggtaaatatccacatagtcagttttcaaattatgtaaactggtgtctaaatcctgccagaatttatccaccgtttttgccgaggtctttgtagcaatataaattttatccctcacgccgctcagcgcatggccgattttctcttcgctgtcggtgtaatccctcgccgtatcaaagaagcgtatccctgcatcgtaagctttccgaagcagagccctggccgcctccatggatacccgctgcatcggaagggcgccaaaaccgttcttattgacgataatccctgttctgccgagcgtcaccggagtcccggccaccttttcataagaatccagcatatcctgaagcgcttcatcgctgtcatcgatccagacgtcctcttcctctgcgttaaggcccagatattttgcaagcgttctttcatcatcggaattattccacctggaaataaacctgtctatttcctcaaattcaacctggcctgacaaatatagctctttaaatgtcattcttcctgctcctttatattcttaagaaccgtgatttcctggttatcaatatgttcgcgcacagccgccttggcctcggccacatggcggttcctgagggccctcaggatcttctcatgctcaatcagaagaatctgtctcttgtcctcatccttgatatattccagacggaaacggtacatctgttccctcagattattcaaaatctgcaccagcctcatgttcctggtacaattataaattacatcatggtaagcctcgtccgtctcggcaatctccatggcatttccattgtcaacggcgtccttgaatgcctttcccgccctctccatttccatgagatcggaatccgtcatccgctggcaggccagctcgatagccagttcctccagggaacgccttacctctaaaacatcctttaagctcttctcggaaatcttggcaacctccgctcccttacgcggaatcatcagtaccaggccttccagctccagttttctgattgcctcgcggatcggggttcggcttactcccagcttttctgcaagctgtatttccatgagtctttctcccggcgccagttcccctttcaaaatggcctgccggagcgtgttgaatacgacatccctcagcgggaggtactcattcatgttcacttcaaaattgtttcccataaataattcccctgtcctaattattttcctgctttgttgttatagaagctggtcagatatacctgctttgagaggcttttcgcactcccatagcgcatttcttcatatgcctcctgagcagcaaccggatttacaaacaatccgaacacggtaggtccgctgccgctcatcagagcatttacagctcccagttccatcattttttctttgatttcccggatgaccgggtgagccggtatcgtcaccgtctccagtatatttcccagattatccgccactccgtagaaatccctggatgccagagcctttgctattttgtcgatattcgggtgtgcatcccgggacagcgaaggcaggttcaggttttcataaacaaatttagtggaaacgctgatcggcggtttggcgatcagaatctggcactgcggcatcggaggcagcggcgtaagaatctccccaattccttcggaaagcgctgtccctctcatgatgcagtaaggcacatcggctcccagctttacgcccctctccatcagctgttccgttgtaaggcccagagaaaacatcttgttaactccgaacaggactgccgccgcatcactgcttcctcctgccataccggctgccacggggatgaatttcttcatcttgatttccacgccttccgtaacgccgaactcgtccatcagaagcttggccgccctgtagcccagattgttttcattgtcgggcagataatagagatttgtttccagcctgattccgggctgttcgctgcgcaccaggtcaatcttgtcatacacgcgcaccgtctgcataatcatccgcacttcatggtacccgtcttccctcttccggaccacgtcaagccccagattaatcttaccgtaggctttaagccccaggtgctttatcatttctattcctccggtcttttcctttcgtagtaaattgtatcaacgcatttttttgtatacaatatattatatacgccgtacatacaaaatacaatactattcggctgtatttttgtctgtttctgtaatttcttttgcatccgtccgcatatacctcttaaatattctgcaaagcaggagtgaattcaggtaaaccgggccggacagcacccagaatcccagccatgaagcgtaatgaaacatgatataaaaaaatacggagttcaggattatcatcagaacagtggacggaagatggcgtaccgccatcataaacgcattgattatcgtcttgaagaccgtatttacaaatcttgcctggatggcatatacatatacggttataaaaagatacagcagcatcagagccagcagcagggcggctgccgcaaagcgcgccgggctgccggaagaaaatatgccggcggaaaagatatcggaggctgaagctcccggcgctctgccccccagaacaaaataccagaaatcaagcagcagcaccgccccggcagccgtcacaatcagatggatggccgtggactgtaccagattgtccctgaatgctttcaaaaagctcctgtatatatgcgactccctgtcttccgccatcttaagagttatataatacaatgccgtcaccgacgccccggctgttatgaccggaagacagagtaaaacggcaaggaagttcagaatcattaaatcccatatcctcgacatgaacataaagaagggattgtcataatcaaataattttgatgccattattaatgcctttcttttgtttattgaaatagtttaaacagcataaacttttactgtttatcgcatatctgtttgcatatatttttcaaacgtaagaatcccctcactcttctgctccgtatcctccgtccttgaaaaacccagggcctctgccaggcggacggaagcttcattcccttccccggtttttatccggacatgacgaagccccagctcttcctccgcatagccgagtatcgcagagcatgcctcaaaagcgtatccacggcccctgaacggcccgtaaatatgataccccagttcccctgccgtaattccggctttccctataataagaccgctcttttttaaaaccagggcccaaagcccgcattcatggaaccggtactgattgtcaatataatcctctctcctggcacggtcagagaatacaccgtccccgtcgtcggccgattcggcttccagcggatcgtcctttgtaaattcccgtatcagaagacgctttgtctgcgctataatccatggaagtccgtattgtcttctgactgccttttccaaaagcatatcgtccgccgcctccatctcacaaaccagatagaggcatgcgtcaaaccctgcccctaaagggcgcacggagggatcccatatcccaataatggctcttcccgccgctgctgcggccagaagagcctcgttgtcatccgaaacagtgaccggatatctgattccttctactgttacttcttttacaattgtcatatcttctattcttcagtctttccggccgtcctccgtctgagcaccggtaaaatcagcatttctccggttccggatattccgttccgaacgtctctgccgtcatcttcttaatcttctgttctttcatcggcctgtcgttccaatccgtcctcatggcggcgattttgtccacaacgtcaagaccttccgtcaccttgccaaaagccgcataggctccgtccaggtgtggtgaatcctcatgcataataaagaactgggaacctgcggaatccggagccatcgatctggccatggaaagcacccctttggtgtgtttaaactggtttgtaaagccattctggctgaactctcctttgattgaatagccgggaccgcccatgccgttgccgttcggacagccgccctggatcatgaaccccttgattacgcggtgaaaaataaggccgtcatagtatcccttattaaccagactgataaaattattcactgtatttggggcaatttccgggtaaagctctgctttcatgatgtcgccgttttccatctcaatagtaacgattggattctgcatatttatttcctcctaagattttctgctcttgtcctataagtgtagcaaaatgcagaagatttgtccagactttaaccaatacggtactggttgggtgaaagtccggtctcccttttgaatatggtgctgaaatagctgaggctctgaaatcctgtcttctcagatatctcagccacagtcatagagctgcttttgagaagctgcttcgcattatcgagtctcacctgctgaagatactgtacaaagttaatgccgaaatacttccggaagctgcggctgaaataagaggggctgtatccgcagatagatgcgaccttatccagatcgaggtccatcatataatactgttcgatataggcttttgcaatatccagtacgccgcccccgtctgaaagtgccctgaccctgtttatggcaaattgaagaaataactgcatctctcccttgatatcctttactgtcgcagccttaaagatccggttgaccacattgataaggctgccggatatttccgccgcatcgattccaatccgcatgcagtactgggccgtctccgacagaattgtaaccgccagagattttacataggaggcccccatgttccggctgattgtaagattcataaaacgttccagaacaccttccccgtattcttcgtttttgaggctgactgcaataatcaaatcatggctgaactgctctgattcggaggccccctcatccccgtatacgggaaccgactgtctgtaatgaagcacctgtcccctgcctttctggaaagagtgttccagggcgcggaaggactgttcataagccctccataaaaaacccttcgtatcgcagaagctgctcaccccgattgatacggaatagcccgtctcccggatcagatggtcccggatcatctcagcgcaggcagtggcgtaatcttcagcctgttccccttttctgccgccacaatccagaaccacaaccaccttgtccgttcctatcaatgtcgtggcaattcccttcatccccaggcgaagcacttcccgcgtcctgttcaatagattccgcttcatcttgtagcggtatgaattatggtggtgctcacagattgtccagaaatcatcataaacaatggtcagaattatctgggggtttatttctatctccatcaggccgaacatgggctgaagtttcgtcagtctttccagatgaccgtatattaaatcgtggatatattccatggacaggatatctttaaacatctccgccgccggaagctcctcctccccgtcatgcccgtgcaggaaataaacgccgtcaatatatccctgccaggcatagggaagcaccattcctgccggagccgcctccatcatcatgataacacggcaccccggattattttccttcaccttctgaataaagtcattttcaatatcctgctgcctgagaaaaagaaagcagtctccggggcccctgctcagtgccagaacttcttcccggttttttgcaagctccatatcaggcaattgtcccgctgccggattgtttttatctaacagacaaatactcctcattctttcctccaaacggtatttaaaattattattgctgccttttcttcaaactataatataatctaaaaacattgtcaattttacacttatgtcaaaaaaattaaaatggagaacaaaaatgtgtatatataacgctttatccttttactataataaagacaagctaagcggccgctttgcaggtaacggaacagaatgaaaaagtcttaggaggtgctatatgaaaaacactccggaagtaccggaaaacaccacaagcccaggcattaaagccaagtttgtcctgctcagcctgatcggaatttttatgttttttgtccctgtcccgtcaaacggagccaccacaattcccattgaatacctggtgagctttctgaccggccactttatggcggcagggcgattatatgcgctggcagtcattctcatcgccactgccatgcctttcataaaaaagacctggaacaaagacgccatcacaaccattttcacttttacaaaaatactgggagcggtattcacggtaatcgtcttttccggcgtcggacctgaaccgattatgagagcggatcacgggcccttcctcttcgaatcgctggcagtccaggtgggaactcttattccaatcggcgccatctttctgacctgtcttatgaattatggttttattgactttgccggccagttcctccgccccctgatgcgggcagtctggaggaccccggggcgctcggccgtcgacgccgtggcctccttcatgggaagtacggccgtgggaatgctgattacaaatgaaatgtacaaagagaggaaatacaacacgagagaagcctctatcatcgccacaggattctccacagtctgcgtatcattttttgttattgttgcaaaaacagcagacatcatgcatttgtggactccgtttttcttcatatcactgattgtcacctttggcgtcacagccattgtagccagaatctatcctctgtcttctaagcctgagacctattatcaggaaaaagagggatatccggaagaaaaactggaggggagccttttgaaagccgcatggaacgaaggactccggatctgtaaagatgccggtcctgtacttccgaacattcttaaaaacatcaagaactcatttggactggtgtttgaggtgctgccaaacttcatgtcaattggcctggtggcgctgattctggcagattatacgcctgtgtttgactggctcggctatattttctacccaattacgctgctgcttcagatcccggagcctctgcttgccgctaaagcggccttcctcggcctggcggaaatgtaccttcccgttctggtcgtcgtaaatgcgccggagctgacacgttttatcatcagcgtcatgagtatcacccaggttttgatgttctccacgacaattccctgtgttgtggccactgaaattcctgtttccatcaaggatatggttatcatctggctggaacggaccatcctgtccttctttatcattgtgccgatatcctggttagtctttatgttgtaaatgccgcgctgcggcctgttaaaaataatcattcacggaggaaaacaatatgttctacgaaccatcaaaaaataatcacggcttatccagaaacccgtttaaatcctgtaccgttccgagagtcatcggatggatctccacaaaaaatccggacggcaccgataacctggctccctacagccagtttacaaatcttaccttcgatccgccgctggtcatcttttccgccaaccagaatgtggtggatgatcggaaaaatacggtaaaaaacattgagcgcaccggcgaattcgtctacaatatggtatcgtacgatttaaaggacgcgatgaaccgctcttccatctttgaaattccggagggaacgaaagacaagttcgagtattcccaggttacaaaagcactttccgtactggtgcaggccgcccgtgttgccgaatctccggttcagtatgagtgtaaatacgttcagacaatccgcatcccgggcaaagacacactggccaccgtggactgtattatcggagaagtaatcggaatacatattgccgacgaattcattcttcccgacggaaaggtggatatctgccgcattaagccggtggcccggctcggatacttcgattttaccgtggtcaataattcctttgagatggccccgcccaaagtcagccctgaaaaacagatcctggtggacaaaggtcttgaggggaaggtttaatcagagaatctataaccgtctgccggtttcaagtcggcaggcggtttttatattgaacagtcagctttattacccggattttgaattagatattcgacgccaactccttgtttttatggtataatgactgcaaagcagtcattataccgcgcataaacggtttctgcgttcaccgcagaaatccggcgctgatttccgtcggagactccatgttccttagggaacatggtataatgactgcaaagcagtcattataccgcgcataaacggtttctgcgttcaccgcagaaatccggcgctgatttccgtcggagactccatgttccttagggaacatggtataatgactgcaaagcggtcattataccgcgcataaacggtttctgcgttcaccgcagaaattaaattatcaaaaggagggcgttacatatgggagaaatgatttcgtcatacgacaacacaaaattatatttaaataaggagacagacatggattgcagggctgtctccgtcattgtccacggactgtgtgaacaccagggccggtacgactatttttccgggctgttccacaaggccggaatcggcacctaccgctttgatcaccgcggccacggacgttccgagggagagcgcacctattacacggactttaatgaactgctggatgacactaacgttgtagtcgatttggcgattgccgagaatcccggcgttcccgtatttctgatcggccacagtatgggcggcttcactgttgccctgtatggcgccaagtatccggacaaaaagctgcgcggcatcatcacaagcggagccctgaccagggataacggaaaacttatcaccggtattccgaaaggaatggatccccatacacagcttccaaacgaactgggcgccggcgtttgttccgtccaggaggttgtggactggtacggaaaagatccttataacacgaaaaccttcacaacaggtctgtgttacgccatctgcgacggcatcacctggtttgaaaacagcatcaaagaatttaaatatcctgtcctgatgctacacggagaaaaagacggccttgtaaatgtacaggacacctatgatttctttaaaaccgttccttcttccgataaacagatgaaaatttacggcggtctgttccatgaaatattcaatgaatattgcagggatgaggtgatcggagatgtgattggatggatagagcatcgcaaacgataacatgcacgctccgcacacaggtcaccgccatcaataaatccggcagcaaatgccggccttatgtatacaatccggttcaatttttctatttgaagaattgccggattgtttttatttatcaggaatattctcctgttaaataaaaaccgctccgcagagtaacgaataaaaatcgaaaaaaagacaacaataaccgtaaaatttgaggaaggatcgctctgaagaaagcgtttaaatcttatgaaaaacaaaaaaccgcactatgcctggatcattcttctgggcgttatcctgatccgcggctttgccggaggaggaatcaattcggtctcagggctttttctgtatcccgtgtcacgcgatatcggcgttggaatagggactctgtccatttatttaagcatcacttccattgtcatggtattatggcttccgctggcagggcggcttatcaaccggtatgacgtccggctcgtagccgcagccggagccgttctgcaggcgctctctttcatgtccttcgggcttatgaattcggtctatggctggtatctgatggcggttccttatgcaatgggatccacgattctggtaagtctgctggggccaatcctgattaaccgctggttcgcaggaaatacaggaatgatgctgggacttcagatggcctttgtcggcttattcggctccgtttttcagcctgctgcctcaaaaataatatccgttcacggctggcgcgccgggtatttatttgtcgggggcgttacgctgactgccgttcttctttcttccgttctctttctgcgaaacaggcccgaggataaatccacgtctccttaccggaccgggacacaggctgacaggagcgcaggccggaaggaatctgatttagtggaaataccggaaaaaatggctttgcactcggcttccttttatttgctgctgttctttatgatttccattaccggtattggcgtttttacacagcatatacctacctatggagcattactcggctacaccacagccgagaccggcaatgcccttgcatacgcttccatcgggagcgcggccggttcaatcgcaattggagtaatcagcgacagaatcggcagcctgaagacgtgctacggcgttcttggaatcggttttttggcaatggccggctacctgctcagcggcagcagtctcctcctctttcgcatgtccgccttttgccagggattaatcagcgccggtatcatggtcctgtcccctattctgacgctgagattctacggccggaaggattatgaaaaaatatttgccaaagtctccatgggcgctccgattgcctcagtcatcctgattcccgtctacgggtttatctatgacatgacaaacagctaccgttttgtcctgctccttatgatcggtctgctgtcggctgctctcttctgcatcagtgcaggctggaaataccgctgtacccaggccggctgtcctgttatatggaaaaacaggcgctgaatgagcagaatcaatgcgatggaaattgggggagtttccttccatcgttcatatttcgttcacaaatcattaaaaaaccttttacacaattaacatgatttcttcatctttcccccatatacttaaaccatagcaattaacaatgcttacaagatttttttcataatatcgagctgatttaagtatcagctctcctccctttttcaaatatcaaaaagcctctcactgctggagaggcttttttgttgaagtcggtgacctgtgcgcgcagcgtgcagattatcgtttggtctggctttcgagtctttatcttttcttatctttttctcctatttctcaacggcgccttcacttctcttgataaaagcagaatgccaatcaggttcggaaccgccatcagtccgttaaatacgtcggacaggttccagaccagctccagcttcgccacacatccgaaaaacaccgcattgagatatacgaatccgtaaaagcagagaaacacctttcctgcgccggtatgctccgtcagataggcgactgcctgcctgccgaggtaaaaccatgcaatgatggtggcaaaagcaaacagggccatagatatagccgtcagatagccccccgccgcaccaaaacactgggagaaacaggcggcgatcatcgcgcttccgtccgtctgcccgtctgcgtaaaacatgcctcccgccgcaccgctttttccggcaatacagagaattacaagggccgtcaatgtgcagctgatgattgtatcgaaaaacacttcaaatatagcccacattccctgttcttcggccgttgtctccccggccgcgccgtgcagcaccgccaggcttcccaatccggcttcattggagaatacccctcttgccacaccgtagcgcagcgcttttgacattccgtaccctgctgcccctccggcggcgctcttaaagttaaatgcctcccgcacaatctcgctgaacacacccggcactttatcatagcagctgaaaatcacaataccgcataaaaacatgtaaaggcaggccgaaaacggtaccagcctgctggcagcctccgatattcttccgattccgccgaaaaccaccgccatcgtgagaaccgttaccgcaagcccggtaatcaggggcggcagggaaaatgcataggtaaagctgtctgaaatcgaattggcctgaaccatgctccccatccccaatgacgccaggacacagaagaacgcatagagcagccctatacctcggttttttaagccctgctccagatatacaaaaggaccgcagatatactgtccgtccgtccccctgtatctgtatctgattccaagatacgtctctccataggctgccgccatcccgacaaaggcagacacccacatccagaatactgcgccgggaccgcccgcagcgatagccgtcgccactccggcaatgtttcccgttcccacggtcgccgccagggccgtacatgccgtcgcaatttgtgattttgcctcttcatcccggtttccaagcgttcctgccgtagatttccaccagtacctgaaatgaaaaatctgaaatccctttaatttgaatgtataaaagattcccgttcctaaaaataacaataaaagccatggtccccatacgagatcatggatcacctttacactctccatcctgccgccgctaattttccattctctgtatctttttattcttctttccagctccttatgcacaaactctatcgcaatccgttaaggaatgtggtatactatgaatacttagcaaaatgtgaaagacgcaatccactgcttttcactcaccgcgaataattgaaaataaaaatggaagagggtattatcatgccaggttttactacccattatatattcggaatgaaagcatacaatgatatgccgaactctcagttaaagcatatcgtagccaaataccgctggctttaccagctcggcctccagggccccgacattttcttttacaacattcccattctccgtcatcaggattacaggaatgtcggttctcacatgcatgaacatcaggtcagccagtttttcgactgctgcctgcgccatatcggcctgatcagctcgagacagcagaaagaagaagctgtcgcctaccttgccggttttattaaccattatattgccgactctatctgccatccctttatctacggcaggatcggctatgacattaatgaaccctcgacgaagaaccacggcctgcatgcggctctggaaaatgagctggatgccatcctgctgtggaaatataaaaagaaaaaaccgtccgaattcaatcagacggccagtatctgtttaaacggccaggagcttcaatttatttcccatttcctggcatcctgtatcaatgaaacttattacccaatcacataccgcaataatttccaggtgacaccggccatggttcaccgttccgtctgggccatccgtttcggctgccgcaccctggccgataaatcgggaaggaagaaaaacagcattgaatttgttgaatccctgtttttaaagcagccggttgcctccgcaaagctggtgaccgatacgatatccaattaccgcaacagctgcaacctggatcaccagccctggtgcaacccctggaaacgttccctggcctccacagcttcatttgtggatctgttccatcagacactggccaagtgcagcaatgtctattatctgttaaataactgcattacaagccctgtttcacttgataaacaggagctttcccttttgatgaatgaactcggcaactattcgtaccacagcggcctgcctgtttcctgaaacaggcgggtcttttttgcgtactccctgcacgatcctgcacagagcgtgcaggttatcgtttcataggacagacttcctgtaaaacggaaaaaacaggacggatatccggctcatacccggttacccatcctgttttaattcttacctgctttgccctgcatttgcaggacgcttatttgctgattcaattacttaacggctgctattcagccgcctgtgtgccgccgctctcctgagccgccaggttcttttccagctccgcagtatcaggaaggacaaaatctacgcccgctccaaaattgccgctgataaaccaggtttcctcgtcatcctgtgtactttcaggtgcaattccaaacgaaagtgcgtaattcttccagaggccgccatacgaatcatcactcgatgtctcaatcgagaaatcctgggtagccactacgtcattaaatcctttaatcagattatccgaataagttctgatttcgctggccggaaaatcatctgataccacccacaccagcatgacttctttcttctgcggttccagaaggaaatggaaatctttgctgtacggatatgcaccagtatcctcgaagacactctctgcatctgcacttacctgagtccagtcaatctctatatcatcctgaatatcgaaattaggatccgcaatctttgtctcagattccgggtttacaatattgctctgtgtacatccactgagaagaaccatgcacgctgctaacactaaaaatcttttcatcaaaagtatacctccttgcgccgcatggctattatataatatacttgttcatttttgtagtcatttttgaaaaattcaaaaaatcttcatattttccaaacatttgttaagaaataagtattttcaagggtttccagcctttgcatatcacttcttccaaaaagtccccgatctgacacatcacatatttttatgccataaataccgccgttttccggttggttatttagccggaaaacggcggtactcatcattctgcggatgccgcatatgactctacggcagggttatcagtttttccgggttctgcttcatcattactgccagctcctgctctgtaatcccctgttttaaaagagcttcggcaaattgaagcattccctcgtcgctgtagggcgcatccgtctgcccgagatcgcttgtcagtatcacatgcccgcagcctacggcacggatttgccgtgctatttcttctatcgtgctgcgccggaaaaaaacgttgttgaagctatgttcaatcattgcccccattgcggcggcttctctctgctgttctatactgtaattcagcgccggatgttccacatgggttaccatcatccgttcgattccgagacgtttgccttctctcagcagagcaagcccttcgtcggcgttcaggtgtccggtccccagcgtcagctgataacgggctgcggtctccagcaccctgacggtctccgccgacagtttcccgtccgctcccgaggccgtcagaaaatgagacggcacttgtgacatttttttcttatactgctgaaacgaacgggcgtccatggtgggaaaccagagcattctgccgcccatctgtccgaaccgctccacggcttccggattaattcccccgacactgcggttcagaacaagtcctccaacaattttcatctgcggaaaatgctcctgtaacagagccgctctggccgccgtctcaaaatagtggcacttaatggcgcatcccttcataccggcagcctcgagccggcggaccgtttcctcgtccgtacactttctcggaattacatccggcgcagtatgaatatgtaaatcgtaggttcctgacagcagttcatggaccatcgtttccacctctttctaaaatggcattacaattggaattaagcatataacaacaagataagtaatcaataccatcggtatgccgaccttgacaaaatccataaatttgtaattcgtccagcccaccgccagcatattctgcggagcggcaaatggagtcgcatacgatgccgccccggccaacgttacgatcatggctaccggataaacgctgactccgatagattccgctacagagatgcaatcggcataaacagaagaattgttgccgtattcgacatcagctgtgttaaaatcgcaatagtgaagaacagtacggttgttatcaggaacgtgctggggttctggccaaagactttcaatatcatctcagccaccaccgtgccgacgccgctgttctgaagtcctgcggacagcgccgacagagatcccatcagaaatgcacagttccagtcaatcgatcgggaggcctcctgaaccgtcatgcatcttgttccgacaatcaccagcgcaccaatcaccgccgcaatatgcatcggaactgcatccggactgatggcaatcacaagcaatacgacaaacagcgtggtacaggatataactgcctttcttttatccagttgttttctctctgtctgggcaaattccggaatataaccggtatctctaagcattttggaaccgaaaaatgcgaagtaaaggctgcccagcacacagacgcccagaccgaacggcgttatatcaaataaacggaaactttcataaccttgtcccaccatcagactgttggcaaatacattggagggaactcccaccagcgtattaaaacctcccagctgcgccccaaacaaaagcgccagcagagctttagacggcgcaataccggctgacaggcacatagccgtgacgagcggggccagcgcagtcataacgccaatgtttgtgcatacagaactaagggcacaggatgcgatcatcgtaaccagaatcgcctttttctcactgttccctgtaaacttagacatcttttcccctattacctcactgattccggagtgaaacagcgaggaaccgattatcatcatagcgatcattaagacaatcgtgttggtattatagatgacaaacacatcctccatcttgatcagtcccgtaaacgcataaaggatcgatgccgtaactgcggaaactaccagcgggaccggttcaaagataaagcataatatggtgacgccaagaatgattaaagcgatagccatttgactcataaaattctccctccaagctgaaattcaagcatttcgatacaaccttccattcctataaattatagatttccaaatctgcgcgccgacttttctgagctaatattagcatagctgttatacaattgtctaacaggatttttttcctgtttcgacaatatttatgttgtttcaccatgcaaaaaacgataacctgcgggcttttcgtacaggttaccgtcctcaagcaatagagcgctgttttccgtatgattctttatattccggacattatatcatatcccgcatttcaggtatcacaaattttggagtgcgccctgaaaagaaatcgtcgatcgcctcggcacaggaaacagaggctctggccgcggcctcctttgtcgctccgccgatatgcggcgctgtcagtacgttttccatctttaacaatgggttttccgggtcaagcggctccttttccagtacatctaatcctgcgcccgctattttttcagcttccagcgcccggattaatgccggctcatccacaatcgaaccgcgcgccgtattaatcaggtaagcggtgtccttcatcagctcaaattccctgtcactgatgctgtgtatcgtatcctttgcggccggtacatgcacggatacataatcactgtttttgaatatgtcatcccgctcagagactatctgaaggtattccggcgcctcccctttaaaaaacggatcgtaagcgatcactttcatgtcaaagccgtaaaatgcctttttagcaaccagtacgccgatatttcccacacctatgaggccaagggtctttccgctcaattccgtcttagggattcccatttttgcatagcggtagtcttctatgtaatgatttaacaccgccttaaaattacgggaacagtagagcatatagaaaattgcaagttcagcgacggaaatgctgttggctcctccggccgttaccaccaataccttattttccctggccgcatccaaatcgatgccgtcatatcctgctccatggcgcgccaatatctttaattttggcgccgcattcagtatattgcgtgtaattttagcagttctcactatcatagcatcgcaatcccgtatatcttcaatgatgtcctgctctgtaaatcctcttccatccacaatctcatagccgtgctgacgcagatactcatatccttccggtaaaattggctgcggtaataatactttataactcatttttctctccttttcttatcagtctatttcataaaacgcctccggatcctggtataaagctccatcatgatccggcagcactgagaggacgacagcgtccccttaaaggagtccggcattaaaatatagttccgcctgctcataggttgaccacattgacggcgttaccgtcaataaacgccccgagattagctgcggcgatatccatcagacggcttctgctttccctggatgcccaggaaatatggggagtaataatgcagttcttcgccttgagcaaaatattatcttctctgattggttcggaggaaactacatccaaaccggctgcaaaaactttaccggattcaagtgcgtcatacaaatcctgttccacaattaaagggccgcgggaattgttgataataataacaccgtccttcattttcgctatattatccctgcagataattccctctgtttcggaaaacagcggacagtgaagggtaatgacgtcggccttttcaaaaagctgatccagtgaaacgtattccccgattccatgtcctgtttcgttcggatactcatcataagccagcaccttcattcccaatgcctttgcgatcgccccggtcgcctggccgatacggccgaaaccgatgattcccattgtcttacccgtcagttcaatcaaagggtaatcccagaaacaccagtcgggacaattctgccagcgtccgtcatgcaccgccttatcgtgatgcccgatatgatgtcagatttccagcagaagggcaatggcaaactgccccacggccgcggtcccataggtggggatattgcagacagggattcctctctcttttgcggcatctgtgtccaccacgttatatcctgttgctaaaacaccaatatattgtatatcagggcaggcgttaagcgtttcgcgggtaatcggcgttttattcgtaattaccgcctgagcgtcaccgatccgatttataatttcctcttcctctgtgcgatcatatacagtcacttcaccgaactgccaaaacccttcccaggaaaggtcgccagggttttccgtataaccatcgagtacaacaattttcatggcattctccctttataatcccctgtttttgtctgctgtccaaagcccgcctctgcccggctcaatcagcagggatatcattccggcagattgggccaatgcattatcaggcttattgtcatgcttcgtaagcagcgtcgataaactcaaatccatgatccagaagcgccttgtccacccaatcccggttagaagttccttctcttacggcaatcagtttcttctcatcggcttcctggaacttctgggcatcctttaaaatctgcggagcatcatttcgcggaatcactaccacgccgtccggatcgcccagaataatatcgcccgggtttacgctgatctcgccgcagctgacgggaacgttgatttcaccagggccttctttataggggcctcccggagttgttcctgtacagtataccggaaaatcccactttcctatctcatcaatgtcacggattgggccgtccagtatgattccggaaaccttttttacgagcatgagataggccatcataatttctcccatcaacgctctcgttgtatcgccctcattggaaacaaccagcacatctccctcattgcagtgattcagcgcgccatgaagcgccagattatcacctgccctgagtttcacggtaaaggccggtccggccatcatctgcgccttaggactgctgaccagatgaatacggggattcatcgcgcagttccgtcccattacatcccccacatttgatgcgggtatcttcttaaagtcctcgattaattgtgcatccggcagcttacgctgtaaataaattcgctttccaactggcatttttcattctcccttcaaattatggttacaatggatatttagtatgtagtaattatatctaaatgcctttttgttttccaacagaaagtttgtgcaaaactcatatatattacaagtatttttggtagtatactgataactatagccatctaatatggcaggaggacgctgccgggacggccaatgtccggggtggtggaggtggttttatgagtcttcagtcccgggttcaggttgtcgtgaagggggaatccggccagaatgaattgttccggggaccgcttgcgctctttggagtgcataacaggtactaaggcgtcacaaaacgccgcctaagtactgatggactcccatgtcccctgcacaattgattctgcctccttccccgggtacaggatcgacgggactgaagactcataaaaccacctccaccatcccggaccctggcctgccggcagcgtcctcataaccataaatcaatcctgaaagaggaggactgtccatatgaatgttaaatatcttgaaagttttttagaagtagcgaaagatttgaatatgaccaccgctgcccaacgcctttacatttcccagcagactctcagctttcagattcagcggttagagctctattacggcgtcaaactttttgagcgtcagccgaaactccagctcacgtatgcgggtaaacagcttgtagaaggagcgggggtgattatcaaagaaaatgaatcactcattaactctttttccgacatcagcagcaagcactccggcctcctgagaatcggtattccggcttaccgcgccgccgaatgtttccctatggtattgcccgattttcacaaacgatggccaaatatttcactggaacttgtggaggaatcctccgaagagatgttacagatgctttgcgacggcgctctcgatctgctgatcggaacccccagccgctctgaagtgtccggtttgaaagaacggatcgattttacccttttactggaagaaaagagctatattatctgttccgatatcctgttagagcactatttcggcaaggatacgccaagaataaaagaacaggccgcctgcggtacagatttgcacgaattttcccaggttccgtttatcctgcacaagcctcccatgaggctccgccgggttgccgacgaatgtttccacaatgcaggctttaaacccaatgtttatattgaatcctccaatacggagcttatgatttccctttatccctgccatctgggcgctttcttctgccggaagtccagacttccttccctgatgaagacactgtcgggatgtaacgcttttcctatcaaaaatgacagtacgcttttacagactcccatctgtcttatgcgcaggaaaaacggaaaaccgccgggacatgtaaatgacttcatgatactgatgaaaacagcgtggaaacacctcgccgatttccctgtatcacccgtttccggggctgaataatttgaggagggagtccccactcacgacaaccttccatgggagactccctcctcaaagcctcccgatcatttcccccgctttgcgcgttcctccagcaggcgttcaaattcttcctgggtacatccgatttcctccaaacgctgccttctcttcctccgccgctcctccataagtctgcgttcttcctcttttctctttttgataaagagaatggaaaacccaagacctgccgccgcaagcacgccgataagcattatccagggcgcctgtttcggcagcttaaaggcaaaattcgcggttccgcccgcctccttgccggaatcactgtcctggccttcaggcgctgattccggcgtttcaccaccggcctgtgccgtctcgtcgatggccgcctgctttgcactgattatgtaaacttctccgactttccggtcattataggtatactcaagaagagccacggctccgtccggatgattctccggaagtttagtaaccacattcttgtccgtatcggaaaactgcgcatccttaggaacggtaatcactgctttagggtcaattgaaaggtcggacggctcataggaactgtcccccagctccaccggctgatcccctgtcgtataggaggtctcattctcagcaattttgatatttttaaagcggtcgaagccaaaatcaagaagcgccttggtatcctgataatgggtaaactccgtactcttcatcgtcaccgcaatcagctttctgtcatccttagaagcgtaagtaaccagtgtctgaccggcaatcgaagtaaatcccgtctttccggcaatggccgcctgataatagttgggatctccctcggtcagcatcttatgttccatcttaatcgtcacaccgtccggattattggccgtaggcggaagacggtagcttttggctgacccaatctccagaagcaccggattttcatatgccgctgttccaatcagcgccatgtcatatactgtcgtgagctgcgtatcgtcgttcagtcccgacggattggcaaaatggctgttctcacagcccaactccttcaccttctcattcatcatcgccacaaaggcgtcgcggcttcctgccacatgctctgccagagcgttagccgactggttggacgaagtgagcagcatgtgataaaggcagtctttcactgtcatcttgtcccccggctccagcgcattcttgttgccggcgccctcttccacgttgtggatagcgtcatcggaaaatgtaaccatatcatccaaattggcattttcaatcacgaccagagccgttaaaagctttgttatgctggccggcgccttttgaacatggatattctgtccaaaaataaccgttttggaatccatgtccatgacaattcccgcttccgactgaatccccgtgtcggccggccagtccggcttcgcgtaggaagtcatggcaggtccggcaagaatcataattatactcaagagtaaactcattaatttcttcataaataattttccccagataattttcagttgccccgcacagccccaaatcccacagggctgtgagttgtgacagtcattcttttctttcaccatcatatcatgtttcatcccgcttcgccctgtcaatattttctaacggcccgcagccgctgcctgaaggaatgttttccgtatctttgacaatataaatcggccggtctttcagttccgtaaacaggattgcaatatattccccgataatccccacaacgacaaacagcatggcgaacataaaacagagaaggaccactatcgtggcatatccattaggcgtaccatgcacggcccactcgtaaattgtgtcaaccattacgataagtcccagaaaacctacaaacattccggaataaattcccagcttcagcggcagatccgaaaaacagaggatcgtgttaatcgaaaatttaaacagctttctcagactgtatttactttccccagccaccctcggcctggcttcgtattctatattgcatctgttaaacccaatattctgtacgtatcccctcagaaaacgtaccttttcccggtaattttccctgagtaccttcgccgccggctcagtcattgcaaaaaaatccgaagcattggcctccagcttcacatcagatatcttattaatcagtttatagaatgcggaggaggttaaattttttatgaatccggccgacctgtttctggtgcggaccatattgatcacctcatacccctcctcaaatccggcgataatctgctccacacattccggaggatgctgcaaatctgcgtccatacatacaaggccgtctcccgtgctgtaatcaagtccggccagcatggccgcctcatgaccgaaatttctggaaaaattgatcaccttgaccttggaattctcctctgcaaaccgtcttaaaatagacagggaaccgtccgcgcttccgtcattcacaaagatcagctcgtaatcccagcttaaagcctcgaacaccggacatgatacacggtagaattcctccagtgcctcctcctcattgtagacagaaataataattgaaatttttttcattgttttgtcatttctcctggtcatatatctgtatctcaattgtcgaatgggccggaacccttttctccggcggcggcagctttctgtaatcgccgtagattaactccagcacatgtgtaaatccaatcggcgccatcagttccaaatcttcaaactccatatcaagcgtcttctcgcaccactcgccttccagcgttacatacaggtaatccggctggtaattactgtaataccagcgctttgtctttttgtccgcatccttcatcgcggccagacgctggagtttgaataaaacaggcatcgggatcagacgccccgccgtggcaaggacgcccacccggatcttgtccgccaggctgtattttgaaaaatcgaggccgttcctgtgggccatagccatgccgtaaataaccttctgcatgaattttgcccgggcggccgctccttttccatcggggagccgatccagaataaataaatccacccacagatgattcagcttcccgtcgtaaaaacgcatctgctcattatcctcgtgtacccggctgttttcgtagataatcctggttgtaaaatcataaaacaccttaccgcccctgatctcttccggccgcagcaccgacattcctacaggcagctccctgggagccaccttcatgaacatctcaaagttctgtcttgtaaataccacatccacgtcgtcgtcccatggaataaagccctgatgacgtaccgctcccaaaagggtgcccgaatccatcatatagttgattttatacttcctgcagatgcggtcaatttcctttaataatttcctgttcgcctcatgaacctttgtcagatcataagtctttgcggctgtctccgtcaccgttttacgcctcttttcctgctgtttcggctgcctctataagcaccttcgccatataatcaatcatttcatcagtcatgcccggataaacgcctacccagaaggtgtcacgcatgatccggtccgtattttccaaagtcccggccacgcggtatccgctgccgctctctctcatctcatcaaagcacggatgcttgatcaggtttcctgcgaacagcattctggtctgcactccttttgactccacataacgcaccacttcattcctgttcacaccctctttgcatgtaatcaggaaaccgaaccagctcggatcggaatttcggcagggttccggcagaatgtactgattttccgtcccctcaagccccgcctttaaacgggtgaaattgtgtttcctgcgctccacaaaggaagggaatttctccagctgggcgcagcccacagccgcctgcagatcggtggccttcagattatatccgaaatgggaataaacatatttatgatcatagcccagcggcagttctccatactgcttgtcgaaacggtggccgcagagattgtcgcagccggacgggcagacgcagtctctcccccagtcgcggaaggagcggattatcttgttcaggagggcgttgtccgtgtaaacggcgccgccttctcccattgtcatgtgatgcggcggatagaaactggaagtaccgatatccccgatcgtaccggtgaactttgtcacaccgtcaaccgtataacggcttcccagtgcgtcgcagttatcctccaccagccagagtccgtgtttgtcacagaatgctttcacctctgccaaatcaaagggattccccagcgtatgggctatcataacagcctttgtcttatcggaaagggcgtcctccagcttcgtcacatcgatattatactgtggaatcgtcacatccacaaacacagggacagctccatactgaatcagcggtgtcacggttgtggggaaaccggcggccactgtaatcacctcgtctccccgtttcactctccgctcccccagcagattggaggtcagagtcataaacgcgatcagattggctgaagaaccggaattgaccagggaacagtagcggactcccagataaccggccagccctttttcgaaccggtccgtataacggccggaggtcagccagaattccagggcgctgtccaccagattcaccatctcactgctgtcatagacgcgggacgcataaggaattcgctgcccctcttcgaagggaccttttttattatgatatttgtcacagtaatcagccaccagtccaaggatatggctgcgcaccgcttcctcacctgctgccgttatcttctcatcagacatcttatttacctccatgtcggttcttttctaaaaattcattgatttgcctgtcggtcacagccagcatatcttcccctgcctgccatgccctcgaccattcaacggtcttttcaaccgcctcctccacgtggaaggcaggctgccagccgaagactctcttgatgcgggagcagtcaagcttcaggaaacctgcttcatgaggtcctccgtcatgcctgttcatccaggtctgtcctccgccccatttctcacagaacagatcggtaagacggcccgtgtccacacagtccgcatcatccggtcccacattgtaatttccggcaagagccggttcctccatctgccgctttgccaccgtcatgtagacgaaaagcggttccagtacatgctggaaggggcggatcgagtatgggttgcgaaccgtgatctctttcccggccatggccgccctgatgcagtccgggataattcggtcgtccgcgaagtctcctccgccaatcacattacccgcccggcatgtagagacggcacagcggccgtcctgaaaaaaggactgcttatagctgtgtgtcaccagctcggaacatgacttgctgttggaataaggatcataaccgtccaaacggtcattttccctgtagccgaattcccactccttgttttcatataccttgtcggtggtcacattcacaaaggagcggacaaaagggcacagccggatacactccagcacattgacagttcccatcacatttgtctcataggtataaaccggttctctataggattcccgcacaatcggctgagccgccaggtgaaagactatctccggccgtacccggtcgaaaacctccttcagacggcctaaatcacgtatatctccgatgacatgatcgattgtattctccaatcccgttatctcaaacatactgggttgtgtgggcggctttaaaccgtatccggtaacctgcgcaccggcaagcgtcagcattctgacaaaccaggaacctttaaagccggtatgccccgtgacaagcaccttttttcctctgtaaaactccagtaactccatatattttccacctcgtatttctgcactgcgtgctgcgcgtaacagttcagacagcaagaaccgttactgctgcgctccttttaccagatcttccagggggcgtctccctcctgccacatattctccaactgcattctgtcgcgctgggtatccatgcatttccagaatccgtcatggcggtaaaccatcagctgtccgtcccttgccatattttccagaggcgccttctcaaatacggtatcatcgccttctatataatcaaagactcccggttccattaccatgaaacctccgtttacaatcttcccgtcatcatcgctcttttcgcggaattcatgaatcgcaccgtccgcatccacatccaggacgccgaaccgctgtccgatattcactccgcttatcgtggcaatcttcccgtggctcttatggaatttaagcagagcctccagatccaccgtagacacgccgtcgccgtaggtcagcataaaggtctcgtcaccgatatattcgcgcacgcgtttgatgcgtcctcctgtcatcgtatgaaggcccgtatccaccaatgtcaccctccacggttccgaataattgttgtgaacctccatactgttgcttacaaggtcaaaggtcacatcggaggtgtgaaggaaatagtcggcaaaatactcttttaccacatactgcttgtatcccagacagattacaaaatcatgatagccaaactgggaataatatttcattatgtgccataagataggctgttcccctatctccaccatcggcttcggctttaaatggctttcctcgctgattctggtgccgaatcctcctgctaatatcactactttcatgggcgtaccctcctttattcttccgtgcctctgcatttccggcggttcaatggccctgcaccggctgccataatctattttctaaaaagattcaggttgttctcttccagaatcttcattgcctttctcactgaatcaggatcattgtgaagatactccaccagctccgcgtcgccggccgtcctgtaattcatcgccagttccctggatatctgaagataatctttccggaaaggggcagtcttcaactcctcctttgtcgtccaggcgtttcctgcaagaatcaggcaggcgccgagaccgacaagcacaacggttattgggcccgggccttttttcacggatttttcagtctcacggcccagccgcatgactacggcaaacgtcagtaatattccgataattcccatctgatactgcagcgcgtatcgggatgtcatgccgtaactgtcttttaagaatatccaccgggccgacagaatcagcaggtggttgatccctccgctcagaatcatgagcagcgggaatattgttttctcatagagacggtatttcaggttcagatacaggctgtacaggtaaaggaagataaccgctgctcccagaagataaacaaatggatcacttccgaaaatacttcctttatttgcaaaatccactatctggttctgtcccagcacagccgaggcaaacgcatttaataaaaaggtgacaaaaaacaacggatctgcaatcagctgggatatgatatttccgtccgtcaccgcccctctgtgtacatataccgcataggaattactccacaggtacagggccaggggaataagcaccgccgcgaggtaccccagatagagccggtttattttccccttttttctataatctgcagccagcataacgagatacaccagagtcagcagagccgaatagcttccgcagtaagggccggccacaaacagcgtcagaaaagagggaagcgccatcagaaagattctgtccctcctatggcagtgccctgttctaacggcccgatcaagaattacataatggcagataaaaccggacacagcggcgaaacaaacccagcccgtcccgttcgtcagcatctcccatttattcagactgaagtaaacaaaaagaatcatcagataccatgggtaggaaattttcttttctttgcctgcgtaaacagataaagctgcagctcccagtcccaatccgaggacaccgagtgccatatcgaaaaaagtgttatatcccagcagctttacattaattattcttcccagatacgttatcggtaccctggtgaggatatccggcacaaaaaatttagccggattccccacatcggggagataggagttaatcagcctgacataatctgaaaaagccacattgtcagcggcaaggctcagatagtaaaaacaaaacgcggttccaagcagtatgggaagtatccagactgcctttgcctgcacagatgtcactttcaccgctttctttctcatcggttccatttatcggtttctcctttatttcggctcctttttgctgctcagaatgttcagatacagttcaaacagctgtctgtgcttctttgcaataacatccagaataagtccgctcatccacagcaggaaggataccacatagatgccggagcatacaatgagcgtgggaaactttgcaaccaggcccgtggaaaaataggcctgaaggaccggcacgaaaaatatggttgcaattataaagcagagcagccccagccagccgaaaaaggcaaacggcttgtaatcgcggaacagccttgcaatcgtctttaacactctgaatccgtctttatacgtattgagcttggagacacttccggcaggcctgtcacggtaggttaccggaacctccagaagcttgaagttcttatcaagagcgtgaatgctcatctccgtctcgatctcgaagcccttggacagaatcgggaagctttttacaaattcataattaaaggccctgtatcctgtcataatgtcttttatatcactggtaaaaatcgtgttgatcaggcctctcaccagccggttccccgtgttatggaaaggtcttttattttccgtgaaataggtggaggacagtctgtcccctatcaccatatcagccctgcccgacagaatatgattcaccatgctcctggcattttcagccggataggtgtcatccccgtcgatcatcagatagcattctgcatcaatatcgcggaacatgctgcggattacattgcctttgccctgacggtattcatagcggacgattgcccccgcctccctggccgcctcatcggtatggtcagtggaattgttgtcataaacataaatcaccgcttccgggagagcctccctgtagtcttttaccaccttcgcgattgtctggctctcattgtaacagggaatcaatactgcaatcgtatccattctcttttcctcctgctttctggttactcttaatcatgtttctctattatcgtttaaaacggtgtgatcagttacgtttaattttctattgccgcaccgcttcttctatcaccggattgaccgtcacaccgcgttttccttcaacggatgaggtaaagcttatcgttattgtaccggataggccggtcagatcaagctctgtttccgttttttggtattcgcaggctcctgtcaaatccaccgttccggctatcttcgccgtttttccatcggaagcggtgataataatccggaacggatatggattgagccaccagtccggatccccgaaaatagcagtcatcttataatggtcggaattcttttccatctggaatcgtccctgccggtcatcggcatatgcataataccatcggttcttccgcccgtccgccatgctgagccttgccatattaaaggcctgcgggccggacagcttatcggtcatataaaacatatcatctacataataccctgctttgttcatccattcaaggtatgcatccaatttctccgcactttgcggaaacatatcgtagacacctttcccttcacgcatgaacgtttccacctgcgccaggtattgatcctgatgggctttcagctccccgacaatcgcattccggttgtaaacgggaacgtctccgccaatcaggcgtgcgtagcttccgtagtcgtcccaggtcagaaagatcacatccacctgctccttcaccgtctgggaaaaaatctcccggtccctgaatatccatctggcattctttttatagctgtccagggaactgtccctcataccccattcgtatccctgccataccgacttaaaaccgtactccacacggcccccaaacggcagtatcagaaggattccggccagtgcgggaagccatcccccagcattcatcagacgaaggtagcagaccgccagcagaatcccatttaatagaattcctcccatgaaataccttgtatgaccggtagtaacggtccatatcatcatggagctaacatatacgccaatcagcagaagttccctccggtacttcccggcctttttcctgcctgttttccggattctgccgtacaggcccgccgccaaaatccccgccattcccagatatcctgcggctaaatccagattataggcacagggaagctcactgagcctgtaatcgggatagcgtatcatgtaccagggccagcaaagcacttctcctggtccggccggtccccagcgcctgtccttaaaattttcaatcggataatattccgattggaatattgtattgtaatacggaaaaaccgggtttcccgtactgactatattgtatacaagataaaccgtaaccggaaccgctcctgccgccaggcaggacagaaacagaggaaccgtgatatcctttcttatcttccagatatataaaagcaccagcggcaccagatatacaatatttgtcatcttcatgcagaaaagaattccgccggtcaggctgaagacaaaagcttctttccggacgctcccttcctccctctccctcaccagaagaaaaagcatttccagaaaaaaagggagcgccagaagctctaccatataggttccgctctgtaatatcaggtcaaagcggcagacaacaaagaaggccacaagcgacggacggcacaaaagcttccacgctttatttccgaaggactcctgaaaccatgcgagaaatacggtgacctgacggtaaatgacaagcattgccgccgcatttaaaagagttcccatcctcagtcccagcagggcgcggaacggataaaatatcctgtcccccagacggaaaccgaacatctggaattttcccggcataacgtggtaattcaaattgtccgtaaaacccgggatctggctcagcagatgataattgtaagtatcatagctcatatccggccggatgcctttgacggcaaagaagcctgctatcaatatgctccccagtaccatataagcatcaatcttaacccgtttcaccctcggaaccccaattacccgccatccaaaaaaaacagtaaaggcaagggctgccactcttgatatgaaggtaacctggggaatgcccgtaagccagcagaataaatcgagtaattcacagctccatattaataccgtatacaaaaggaaagcatagaacgcaaagctgcctgccctccagttacttttatcaacattataatccattatcctgcaaactccgttttcctgtctcatgtcttattggatttcagttcagccttcggccaaactgctgcaaatgcgagacctgtctgaacttaccgttcacactccgccaaaaaacggcgttctgcgaacaataacacctctcgggatactgcctgtcaacagtaacatctgaattacaatcactgattgaagaaatgctcttctaacatcaggcagagagcatgataaatcggaagatgcagctcctgaatcttataagtctcattttccggcactacaaccgccgcgtcgcagatccccttcaatcttccgccgtcccttccggtcaggcctaatactttcattccctttgctctggccgccacggcggcatacataatattttcagaatttcccgatgtggtgataccgagaaatacgtccccctgctttccaaaacctgtaatctgctgggcatatatcatttccccgtccacatcgtttaaaaaagcagtggaaagccccggatggcctgtcagggcgatagccgcaagcccctgttgcagccggccggccagccgttctccccttgacgggtcagccgcaataagcgcctctttcatctcttccgataccggcctttttttgacaaatcccttcatcagctcgcctacaatatgttccgcatcggcacagcttcccccgtttccggcaatcagaagcttgcctccgttttcatatgcttccctgataatctcataggatgccttgatatcgttctctgtctgctttaacacgggataccgttctgaaagctctgtcagatatctgtattcattcattctcttttacctcctgtttcaccatatccgaagtgatgtaattctcatcaaacagccgcagattttccgccgctttttctcccggcagcttttccctgctgtaccgggccagcatatttccgttttcaaaaaagaaatcggtcagaacgccgtccgatatcaggtcccggagcattccatagctccactcccagctgtcggtgccgatatatccggactcggcgtaaacgtaatccgtaccggcatactccatatattcttcaaacgcttccggggaattgaccagctccacatttccccacggcgatgtgatgtctttgtaagactgtacgttgcacggaaattgcagacagaacggatgatctccaaaggcgatgaccctgttttcaggatcggccgccagtatctgccagatagccgcatttcctttaataatcatatcttcatgctgctttgctttatggttataacgccccttattgactggccgtatctctgaaaaccccaccgaccatgcccagtttgtctgcgccgtcaacaggatattaaacccgagaagcggcaccagcaggaggatgaccagtcctttggcactcttttgtgcaaggcctgacagcttccggcaggctatgagtaccagaaaggtgtatagcagcataaaataattcccgtccacctgataaagcattaccagactgatcagattcaccgccagaaacggccagaatatcacggcagcggcagtggcgataccgcccctctcctttttttcggctgcccccatcattacggacacagcgatgaagagaaccagaaaaaagagcagggaggttccccaggcgataatcacatgccccatgtcctttccctccggcgataaaagcatctgccagagcctgcggagcagcacatgaagattgctctcatcctgccagttttgaggcagggaacctgtggcaaaagggtatttcatctcaaatcctaatttcgcaaaaatggaggtgaaaacggaggtcacaggcattcctgttatcatcatggttctcgcccagattcctgcgagggccgcccccggcaggattatggacgcccagtgcctgagggatgcgcgaaaagacagacgcctccaaccgatcaggtaaatgcccatcatgccgaatacggctgttgaaaatatcagggaggtgggtttcatcgtgagagacaaaagatatgctcccgccgacagaattaggagcgttacattcccccttccggatcctttaccgtttctatcctctcccgccccggtactaatcagataccggaagaaatattctatcataatcaactgcaagagccatgtaataatatcaggctttgcagaaattcccatattcataattgcaggcagggaggcgcacagagccgctgccagaacactgtactcccgtcccataaaaagacgggcaattctgtaaaccatcataagccccatcacagccagccaaagtgtaaaaaataacaggtagctgtgcgaagccaaatccgagaggggaagtgtcagaacctccagccctttcgaatagacataaaccatccccacgagtccgggattttcgtaaattcctgcgccgccggccaaaatatattccgaccttacgccataccagagcgtgtcaaagtccagggcaatgttcatcctgcccgcctggatcaggaatgccgtaaaaatcagcgtataacagcccgggtaaaagaaccgtccgaaggagcccgttttcctatcactcccccggcccgcagaatcggctgctttttcttttcttctcctctccctgtaaagcttcgcgccatagcatgcataaaggacgagaccggccgccgcacagataaattgcatgaccgggatccggcctgctccggccgccgaaaggaggcagaaaaggagaatgaccgcactgctgcccagcaggaaatctgccggataaccgctgtggtcctctatcccgaacaccttctcccggagaaaacgcccggcaagcaccagaaatccgagatacagggcggaaagaaccatggggaggaaaaccacgtgaagccagcagaacgccgctcccagaagggccgccgcggccgcctgtctccccttattttttatcaggaagaaaatccctcctgagagcagaagaaggacggcaatctccgccagcattttagcagcttcaggggttctgatataaggcgccaggaaaccgtctccggtaaacagcgtgacggccggaagcgcgatggacagcacggctgcaggtatcagtattgctgcaaatattctgtttctaagctgcatcttttgcttcctcctgttccatatttgttactgttcacactaacagatgccctcaacgacagcgcgggccgccgcaagaagattggcagcataatagtcatagctgccgtccgtacacctgccgtccggcgtcagctttccggccgcttcctgctctttccgaatcttactgccatatccggtaccgaccagaatgctcctgattccgaaattatgtccggcctccgtgtcaatcagcttgtcaccaatcatccaggaattttcccggtcaatgccgccgggcagctccctcgcggccgcctcaaacattccggttcccggcttccggcagcggcatgtcatcttatatctgccgataccatgctccgggtgatgggggcagtagtaaaatgcatccacagcggcccccgattctttcaacagattgttcatgtaattatgaagcgcttccacatccgcttccgtgtaatatcctcttgccacaccagcctgattggtcaccacaataacggcgaagcctgcctcatttaacagcttaacggcctcggcggtgccgggaatcagttccagatccccggggttgtgcagataattcacttctgtattcattgtgccgtcccgatccagaaataccgccttccggggcgccgtcccccgtcccgtatctctctgtccgcccggccttttttctgattccatctctaatctcctggtatttgaattgccttccgtaggatatattaaaagttgaattgatattccttatccggcatctgtaccttcacatcctgatactgccatctttcgtcattgcagatccagctctgtgcgcccctcagctcaaaattccagtccataagctgaccgccgacctgctccagacgggcggcaaccttatgcttcacattataagggcaataaaccagaaggaacccgccgccgcctgctcccagcagctttcctcccaaagctccggcctttttggcctcctcataaagcgtgtctatctgcggattgctgattttgctgctcattctcttcttgctctcccagccgtagtccagaagcttgccgaaattgtgcagatttccttttaacagctcatccttaatcgcataagaaagagccttcacttcacacatggcttcaaatgcatcctgctttttgtagttgttgacctgatcccggatgatattggccgaaacgtggatattgccggtatagcacaaaagcaggttatactgaagctcattgatgatatccctccggatccgcagaggattgacaaccacattgttgcggccgtgaaattcaataaaattaaacccgccgaaggttgcggcatactggtcctggtaacccccggcgattttcagatcacaccgttccacaccgtaagccagatccgccatcgcataattgtccatctcgattcccttccatctggccattgccgtaagaagagccaccatgactgtggaggatgttcccagccctgaccctgcaggcgcatcacactgcagataaacctcgcagccctgcttgatatccattgccttcagcgcagccgtaaccaaatccagcttgccgtcgtagacataattttcattcgtgttgtatttcaccgtcatatcgaagtccagggaatggacggtgatatgctcgtcatctctcggaatgatggagcagtatgcgtatttgttgattgtgctgcctatgattgcccctccctgttccaggcagaagggctccacatccgtacctccgccgccgaagctgacccgcagcggcgctcttcctctgattaccatctgatgactcctctcttaacatcctcctgaaaccggaaataatcctccggcacgccgatatcaataaaatatccgtcgttgacaaagccgcccagacgctttccctctttcatccatccgggaatcatctcattctccagggaaaccttacctgccggaatctgctcaagcagttcccggctcatcaggtaaacaccgccgttgatggtgccgggacgcgcctctcccgtcttttcattgaagccggccagcatcacgccgtccaggactgcctccccgtatcgcgttacgtccggtactccccggagtaccagcgccatatccaggcagttctcttcctttatcttcataagccggcagtagtccatctcataaaatgtatccgcgttcagaacaaagaaattctcctctgtcacaaaccttcccgcattctttatggctcccgccgtacccagaagctcttcctcatatgcataagatgccttaatcccggccttcccgccgtttccaaaatactcttccaccatgccgcccttatatccgaccgcaaatataatatcatcgattccaaagcgtgtcaggccgcgcacgacgtaatccataaaaggcctgtcctcaatcagggccattggttttggacggtcgctaactacgctgcgaagccgcgttcccaaccctccggccagaagtattgcctgcatttttatcctccctgtatcactgcggtttcaggatcgtgaaccgccccgacttatagctgagccttaagctgttcaaaaaatttcctgctgagttccttatccagcactcccacatatgccgccagcagcatccatgtctgctccagccctttaatatgggttctctcctgaccatgggatgcagatacccccggcccaatcagcgcgcctcttatatcattgcctgccgagagagcggaagaaacatcggagccatagtgcgggaagatatcaaccgcatacccgatcccgtattccttagccaggctgatcagacggtttgtcatgtcaaaatcataagggccggaggaatccttggcacagatggatacccggtattcatctccgctcagatcatctcccagcgcgcccatatcaatcgccagaaactcttcaatatcctccgggatataactgcacccgtgtccgacctcctcataattgctgatggctatcttgagggtctgttccggctggcggcctgtctcatggagatacttaagcaggcccaggattacggccgcggatgccttgtcgtccagatgcctggatttgataaacccgctgtccgtatagacaaacttcgggtcaaagctgatgaagtcccccggcccgatacccagctcctccacgtcctcttttccgcgcacaatctcatcgagacgcacttccatattggcttccttgcgttccagtgtcctggcatcatcgtaggtgtgcaccgacggcgccttcgtctgaaccgtccccgtaaaggtctttccttctctggtatgaatgcggcaatagctcccttcaactgactgcatcatgaaaccgcccaccgacacgatagccagtgttccgtccgggcggatggaacgcaccatggctccgagcgtatccacgtgggcagacagtcccagcaccgtctccgttcgtcccggcactgtgatcagcatcccgcctttccggttataagcggaggaaaatccgaagcccgccacctccttttcaatccgttccatcacctgctttgtatagcctgacggacttggtatattaacaatctcttccagaatatccactatataattaatatctttcatttttccctcctgcgggcacagcaaacccagtttaacttatgtattttatcatagttccccgctattttctacctgatactggcacaaaagcgcccaaaagcctcaaaagtaagaaacatgaaaacaaaaattaaataaaaagaaagaacagcactgcagtcagtactgtcccgtctccctcagatactcttccatcttaatcagccgttcttcattctggctcttgttcttcttgctgacaaggcccagcagtacctccattgccatgacaagggtcgtgtaggagttataaaaggacaggttctcagtggaattgagaataaccgcctcggctccgctgcaaaggggcgacgtatatttgtcggtgagggccacaatatgactgcctgcctttttagcgatacttaatgcaaataccgtgtcgctggaatatctctcgtaagagagaccgatcaccgtatcatttttagtcagatccaccagggaatcaaccagcggccggctgccgtttacaacatagatccccggacgcacacagcccagcatgacgccgaatgaggatgcaaaaccggcacaagtcctgaatcccacaataaaaacccggtcggcctccgttatcagctttgccgccttccggtaattgacataatccgccgtcgtctggtcactctcaatattccgcattacattcgcctttaataccgcgataatctcatcttccgacaggctttcaatcgtctttatcttctcatagggaatctgtgccttctcctttttccggctgtccgcaagctcttcctgaagagccctcttaaagtggctgaaattttcaaagcccagcttggaggatacacgcactacggaagaaggactaatccccagtatttgcgcaatctccgacgatgtcataaaacaggcctttgcccggttcctcagtatataatcaaggactatcttatccttcggtgtcagcttcgcctccccgggtatatttttaattctgtccattttgtacctcctcgtataataagtttgtaagcaagaaaaacagcttacagacttattcttttttggtataaatggtaaggatatctaagaggtactcccctcatcccgattcccatctatacagttaatcgttacattttaatatggtttattctgtgttatgatatcagcagagtctgatgtccgaaggcactgcttctcctcctttcagccggcttcgtccgagactgcccgaatagcatgcagcctggcacatatggcacattccgcttacacagaattttcatccccagccggtagccccagcaaaaaaggctgactgggtgcatgctcattgcgcgaggtttcggtcaccgtatgcagcacaggataaaccttttgcttcaggcttcacaaatccccatcggaatggaggtgatatcatgttaaagctcaactatatgtccaccttgtttgtaggtattgatgtaagctcaaagaccaatgctgtctatgctatggacttcgaggaaaacaaatacatctcatcatcgtttggcaataaccagccgggtgccgataagcttgttaatatgattgctgagtgtatgcacaagcataaaaacctgaatacgattcttatcgtgctggaatccacgtctgtatacagcgtccatatttcaaacttcctatcgaccagcgaggttctcatgccctacaagccttacgtcttctgtgtaaacccaaaggccacttcgaattaccgaaagtcctatatcggaatggaaaagaccgatcccacagatgcatatctcatcgcagactttggcagggtaggccgtacgaaaaaactggagccatggcgcggcgggcagttcatagcccttaaacgccttacaaggcaccgtatgcacctttctgagtgcatcaccagggagaagacttatatggtttctaatctttatctgaagttcagtgaacttcagctccttgaaggtgatgacaagccttttggcagtctctatggtgccacatcctcagctgtcctgacggaatttttgtctccacaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgaacgtatcactggcaagctcgtttaactgcatccatgcctatcagaaagaaatcaagctgatagaacaggcgattgagaaatgcatcaacggaatgaaccctaacgccctgctcatccttcaatccatacctggaataggtccgatatgggcatctggaattctatcagaaataggcgatataaccgtgttccattcatccgatgcccttgccaaatatgccgggctttactggcctaagggtgattccggagatttcacttctgaggacaacaaaatgtcgaaagccggaagtccctatcttcgctactatcttggcgaagcggcaaacagcgtcaggaagcacatccctgaatatgctgatttctatgccagaaaatatgctgaggtaaccaaacatcagcacaaaagagcactcgcgcttacatctcgtaaatttgtacgactcgtttttggattgctggccaaaaaccaactgtacaccggcgaaaagctggacgccgaatataatatcaaatcgaactgaccttcggtttcgtgcaaagcatacccgaaggtctgttaaagttacccttttttctgaaaaacatatcaaaatctttttcaaaaagttcttgacatatcaccagaatgctgttatcagaatagaacggtcctcaccaactaataccaaaatatatccatgccttacatttaccgcaaaattataattgacagaccggatacagataactataattgaccttataatgattcttatcaatcacgagtaacttatttatgattttcaaaattcattatagggaaatttcgctgttttggcaagaggaaatatctgttttatcaaaacgatatattaagagtattgccggatacaatagatttatgaacagcggacaggcgggataagacccacccgccggaaaggctcctatggcacgagacatgacacagggaaatataacaaaacatcttctgctttatgcagggccgctgataatcggcgatctgttccagcagctatatcacacggttgactctgtcgttgtcggtcaattccggggcaaggaagccctggcggccatcggcgccgccgggcctgtcatgaatatcctcatatttatgatcgcaggaatctccatgggcgcctcaattttaatggccgaatattatggagcaaaaaagtatgaggatctgaaagaggaaatggctacctcaattggcgcaggactgcttcttactctcgtgctgtctctgctcttttatgcgggaagcgggctttttatccgtcttacacagacaccggaggaaatctcccatatggcggcaggatatctgagaattatttccgccggcctgatatttaccttcttttataacatactggctgccgccctccgtgcgatcggagactccagaacctcactctgtgtgctgatactgacaacaatcatcaatgttgttctcgatatcatcttcgtcaggaacctggatttgggagtgtacggggctgcctgggcaaccgtgattgcacaggccgtttcctcgctggcgctgattctttatatttacataaaggtacccgtcctgcggctgaagccctctgaaatccatatcaatctgaaactgcttaagaaaacagccgattacagctccgtctcagccctgcagcagaccatgctttacctcggacggctgctggtccagtccggcgtcaacaccctgggcgttgatgcggtagctgccttcaatgccgcttccattatcgacagctatgtcctggctccaggcagcagcctggcgtcttccgtcaccactttctcggcccagaacagaggcggcggaaaatacgaccgcattcccagaggttttggaatcacaatggcaatcgccgtcatctacactgtttttgttacattgattatcttgtttgccggtcgtcctctgtttgggatattcctgaaaccgtgggaacaaaatgccattgcgctgggactttcctatatccgtcccatggcctgtttctattttatggccggaatgactcacacgttccagggatacttccggggtatcggcaggttaaagttcactttaatcggcaccttaatccagatcccggtccgtgtcatactgacctatgggctgatctcacggcttgaactgaagtctgtggctgtcggcactgtgcttggctgggcctgcatgatcgtctttgacatctatgcatacagaaaatatggccggaactttaatcagatttaaaaatccagggaggacttattatggttcgtgacatgacacagggaaatgttaccagacatctgcttacctacgcagtgcctctgatgttcgcaaaccttctgcagcaattatatcagacggtagactcaattattgtcggtcagtataacggcaaagaagccctggcggccatcggtgcagcggggcctatcatgaatattcttattttcctgattgtgggcctatctctgggcgcttctattctgatgtccgagtactttggcgcaaaagattataaggctcttaaaacggaaatggccacttctctggtctccggttttatcctgaccatcgtactttcactcctggcttttaccggaagcggattgtttatacgcatgaccagaactccgctggaaattgcgccgatggcttcacagtatctgaaaatcatctccctcgggttaatatttacctttttttataatatactctcagccgggctgagatccatcggagattcaagggctcctctctatgtactgtgcctgacaacgatactccatgtccttctggcagtttatatggtggggacgctccatatgggcgtacagggcgcggcctatgcaactgtgatttcccaggccgtctcttcactcatgctgtttatctatatcaaagtaaaggttccttatctgaggctgtcactgccggagcttcatattgatatggattttctgaaaaaaacggttgatttcagctccatctcggctctacagcagaccgtactctatatcgggcgccttctggtccagtccggcatcaacacactgggagtcgatgcggttgccgctttcaatgccgtctcgattatagacagctacgtcctggccccaggtgacagcctggcagcctcaatcacaaccttcaccgcccagaataaaggcggtaagcagtatcaccggattccaaagggcttaaaaaccgtaatcgtaatggcagagatttatacaattgccatctccgtccttgtactggccggaaagaaccagcttctcggcatcttcctgaaaccggaagaaaccgaagcgctccggtttggcatattctacatcatcccgatggcctgcttctacttcctcagcggaatcaccaacagctttcagggttatttccgtggcatcggaaatctgagagtcacactgattgcgacaattatccagatccctatccgtgttattctgacttactcgctcctgggacgttttggcatccaggcggttgtaataggtactacgattgggtggtgctgtatgacggtttatgaattggtttcctatcgaaagtggagatttagttaagcaggtgaggacgccgccggtacggccagcggacggggtggtggggtgtgtatatgagtctttcgtcccgggggagaattgttgtggtttggggctgcgggcgaagataaagtctgcggagcacgctcccgctctgtgaaatgcatcgcgctgctaagctcgacaggacctcgctaatcagcgatgaatttcaacggcatccgcagactttatcttcccctccgccccaaggccaggttttcgccgggacgaaagactccgccaagtgtatcggccccgtccactggcctgcggccgctgaatgtctcacgcgttaagtgcgggggcggaccttgccgcggccactcagcgctttcgtgtgcgggaaatacgatatgccttcaatgcgcatttttatataattgcggaaggtttgatatcagcctgccagaaacacgtagtggccgcgacagggtcctccccatttaaggttagagacaatcagcgcccggagcggaccatatccggtgtcgcgaaaacttccgcctgagtgttccgtccccggtgaaaaactgacccggggaagtaggcggaatcaattgcggaggggacatgggagtccgccggtgcttggcgaggtctctcacgagcttagcactgttgcgcactccaaagagtgcaaacggtccccgcagcaattcattccggccggattcccccttcacgacaacctacccacggggacggaagactcagacagactcccccactacaccggacatggtccgttccggacgcgtcctcccaacctcagttaaatctccatactggaaattcacgaaaccgcttgtaaattatatgcttaggatgtatggtattcttagggaaattatatcatttacattcaacacaggagggttacataatggaattcaaattaaaaattacaatggccgatccggccggaaatcggacagcattcgcagagggcgaggttccgcccgagttatatgcggcagtgggcgccgccattttaaaggaagaagatttaaatgcagagcaggccggttttctgcttaaaccgctccggggcgccgcagggcgtatggagatgatgggcggggaattctgcggcaacgcgtcccgaagctttggtctgctgctgggcaggcgaaacggcatgaaagccggtgagcgtattcccgtagaggtatccggaagcaaagatatcctggaagttctcctggaggaagacggttcctgggtgtccatgcccctgcctcaggcaattacagagctgtcgctccccgaggaatgcggcagagacagcggtatttcctcttccgacggcagcggactgctccgctttccggccgtggttctggagggaatcacccacgtcattcttgaggatgtcgaaccttctgaaactctggcgcacgctgttctcgacaagatggcgaaggaaacggatgtggatgcagcaggggctatctttatcaaggacggtgagatgacacccgtagtctgggttcgggcaaccgacagtttcatctgggaaagcagctgcggaagcggcactctggcttcgacggtatggctcggccgcgatgtggccgacggcgatttccgcctggagctgaagcagccgggcggtatattaaaagctgaatttaccgcaaagaacggaaaaatcactgatgccagaatcggcggcccggtcttttttgaagaaccggttataaagacaattgtactttaacgccgattagccttctgaaaccaaaaatgactgccgagagttccggataccgcctctatgacggagaacagtttgacaagcgcttccctggataaattcctgttgccagggaagcagaatttaaataacctttaataataatatcattgtcgattgttgtttttttgacaacaggacagggaaaagcggcagagttggatgcatcttgcctatgcatctgctctgccgccttcgttgtgttgtttaaggggttttttaagtagtaatgctatattcagtttttagtgttacttacagtacctgtgccgccaggatagctgcgatcattaacgggatattaaagtgtaagaatgtaggtacacatgtgtcccaaatgtgatcgtgctgtccgtctgcgttcagaccgcaagtcggcccaagcgtagtatcggaagctggtgaaccggcgtcgccgagtgctgctgctgcagacatcaggacgatagttgctgccggagagaatccgatcttagagcataacggaacatataatactgcaagtacaggaactgtaccgaaagaggtaccaatacccatagttacaagaagaccaatcagtgtgattacggttgcagcgataaccttgctgccgcccatcagtgtgatggaactgtctactaattcattaacagcgccggtatctttcagaacctgtgcaaatccgcctgctacaagcataacgaacgcgataaagcccattaatttaataccttcgttgaactgttcatcaatatcttttctctttactgcgcctgtcaggaacattacgagaagtccgcccagtgctgcaaatggaagagaaccaaatttaatctgaagaattactacaacaacgattgcagcgatagtacaccagtgctgtgtagttaatttcaggcttgataattcatgtgtttcaacaattgcaatgtctttatattcacgcggttttctataggttacaaacagcgcaattaaaagaccaatcagcatggccactgccagaatccagttaacggatgctacatcgttaagggttacttccataccattcagagtcatattgtctttgatgatacccataaagataagaccaaagcccatcggaattgcgatataaggagccttgtggccgaacgcgatggcacaagccacgccgcggcggtcaatcttcagccggttcatgactaccagtaacggcggaatcagaatcggaatataagcaatatgtacaggaacgatattctgagaagcgcaggcaataagaacaaggataaaaataaggatatatttattctctcctactactgctgcaaccttcttagaaagaatcgttgtgatacctgtgtaagccatacaagctgcaaacgttcccagaagaacgtaagcaagtgctgtctcaccgttcccgccaagtcctccgagcatggaagacagagttccggttacccccagtccaccggcgacaccgccgatgaacagggaaataagcatagataataatacatttactttaaataaacaaagaatacaaagtgataatactgccaatactacagggttagttaacataaaagccctccttcttcatacatacttgctacttctccactccccagagaaaaagtaaacaacacacccctcaaactataattcaatagaaccgccaattgcttcctctacggcctttactaaggagccgtcagcgataatattctcacagtagttaatatcgtcgtataacggacgatcttcttcaaggcgggcaacctctttacgaaccaggtcgtatgcagcctgtgttcccttaccaaggcccttattgcctctcatgtcgataccctggcatgcaaccatcagatccatagccagaacacgtctaacattgcggccgatctctccagcctgtcttgctgcgattgtacccatacttacgtggtcttcctgacctgcggaagatggaatactgtcaacgctggccggatgagccagaactttattctcagatactaaagcggctgcggaatactgaacaatcatgaatccggaattaacgccgccgtttggtgtaaggaatgcaggaagtccgctgtatgccgggttaacaagacgctcaatacgtctctctgcaacgttggctaactcggattctgcgatctttaagaagtcaaagctgagagccattggctgtccgtggaagtttccgccggagattcctgctctgtcatctttaaagatgattgggttatctgttacggagttaatttcgatatttacatgctcttttacgtagtttacggcatccttgcttgcgccgtgaatctgcgggcagcagcgtaaggaataagcatcctgtacacggatttcgccctggcgtgttgtattcttgctgccttccagaagctttaacaggtttcttgccgttgcaagctggccggaatgaggacgaacatcatgtactctgtggtcaagcgcgtctacgacaccattctgagcctcgaaatcaagagctgccgtgatatctgcaaccttcagaagattcagtgcatcataaagtgcaagagtacctgcggaagtcatagcctgtgtaccattgttcagtgcaaggccttcctttgcggataattcgatcgtcgggattcctgctcttgccattgcctctgcacccggaagaacttctccctcgtactctgcaaggccaaggccgatcatcggaagtaccatatgggataatggagctaggtcaccggaagctcctaatgaacctttttcagggataatcggtgttacgcctttgttcagcatgtcaaccatggtctgaagtgtctcaagacggattcctgagaaaccttttgccaggttattgatacgaagaagcatgattcctcttgcgatatcttttgtaaatggattgccggcgccaacggcatgtgtgataatcaggtttttctgtaagtctttgcactgatcctgtgaaattactacatcactgaatttaccaaagcctgttgtaataccataaaccaccttttcttctgcgattaaatcatctacaatctgtctggactccagaacacttttctttgtctcttctgataattccagcggtgcgcactcacggcaaactgctacgatctgttcaactgttaaatcctgtcctgtaattactactttgctcatcttatcttctcctttactgctgttatttcatacgttacatcgttccggcacactcattttgccggggcaattgataggcctattatagtacacgaagcgtcaaaaaagcgtcaaatcttgtaatattactgacaaaaattattttttatatatgttttcttacttttatactttaccttgctaccatgacagactttttcgctttaatttgctaccatgacagacttctttgctttaccaattcagcgcaacacccgatatttaaaaatacctgctccggcatactgtttgcggataacgacagcctgcacgctttgcacaggtcaccgccatcagtcaaatgcggccgggagagctttacacagactcccccggccgcaccggtactctctttttaattcatctctcttttcaccgcctccagaagctgttctgtcgtcggattcccgattttagcagataagccgaccgccctgctgtaatgctcggccgcttcctccttccgccccgttttcaggcaggtcatggcaaggtacgtctcagctctttcaagcccccatctgtatccgttcttctcgaggcattccctggccctctccagataattccacgcctccagaaaccttccctggcagtacataacctggccgatattgcagtagacctggccgataccgtttgtctccaccgggccctggcccactgttatccctttcatgtaatactcaagcgcttcatcatacctgtcctgtatcctgtagatatcaccgatataattaaagcaggcggcgatgcttgccgtatactttccccctccgtcttcgagctcgcggaataccataagcgctttctgaaggacatcctccgccatcctgtattcctgcctctggacatggtaccatcctttcagccggagaaaggtggcatactcatccctctcttccttttttatacagccaagccccagggtcacatatttgtcaaccttttccaaatcttccctctgaattccatgaaatacctgctgcttatagcaggccagaagattcttatgggcattcagcttctgggccagaaaaatacttttctcaatattggcgataccgctgtcgtaatcgcccatcgcgatgtcatatcttccttttatataatgcatctccatcttcatcttgcgtatctctctggaatcgtctttcaggttaatgacgtcctccgccagttcaagcatctttgccgcttcggccatgacaccgaaatcgtcgccgaaatcagaagcttcggtatggagtaccggaaaattctcattgattaccgtgtaaaattctttcaggtaacgaatctgatactggtatgcctttacctgatcatggcatttgtcgtaatggtagacgacaaggggaagtacggtaaaatcctgttccgcctgggcctcataataggcagccagcattttgtgataaagctgctttttcccattgctctgtttctcgtaaatatattcctggaaaatgcggtggacaaatttataatagacattccatccaaccagaacctctttaataaggaagccttcctgcagcctttccagaattttaagaagggtcagcctgtccatgcccttcatcaaaagctctatttcctcaatacttatcttctcagggaagaccgacatacagtccaggacttccttctcatcctgggatattccggacagcctcgccttgattacaaagtttgtcttcggagatttttcaagcgtgtatcccttctcacggataatgttaatcatttccgtcaggaaaaatgcgttaccgtccgtcagctcatataatttttgacgtttctccggttccgtgtcaagctccggtaatgatttgtgcagaatttcatccgtttcttccttcgtaaacggctggagggctatgagtttgacagaatctctgcggaccagcggttccagcgcttccgtcacctcggcctcgctgcttctgttatacgtgcatatggtcagcagcacatccggttcaagcataaactggaggcggcacatgagctgaaagctcatctgatccatccactggatatcgtcaaatgccaggactatccggtatttcttcgtaatctcggtaaacaggctgattaccgtcttctcaatcatctggtaagtaagacggccgctctctctgtcgtcaccgacaccccggttcaggagctgggaaagcttttcttcctcatcgggagacagcgcccccttcattgtcccgttctcaatacattgtctgacttcctgaaagatatcattccaggggtttaagaagaaatcggcgccctgcctgtagcataccgcatagagcgtgatcatctgtttccccagcgccagcttcagtccgcattccagaaaggacgtttttccgacgccttcctccccctctacagccagacatccaaccttctcgcctgcagtcctctctaaaaatccgctgatttcgtataattcttttttacggccgataaacggcaaatcaacggaaacgccttccgtcttcacatgctctttcacattaaatacacggtggaacagatctttaaccttctgtgacggttccatatccagatcatcctggaacagcttcatcagatcataataaaggcggatcgccatcgtgtaattgccgttctcagcatagacattcataatctcataatacagctcctcattgtaaggatcatttttaataaggatattactgtacttctgaatcagggaaagatcatttttctcgcgcgcatcgtcaagatgctccctggcgctctttgagatattctggcgctgtccttcgcggactccctccacccattcctcaaattcataacagttcttaatataaaaatggtccaaaaaaacaccgctctgtccgacatcaccatcctcacggcgctccagatcaatcataacgggatagtcaggattaagtgctatccccgtatgtccggttgtaaccagaaaatctttatctataaaccggcgcacctgataaaccgcgtcacgcagcttctttttcccggttgtctcgtcttcatctccccagagaagacagataacctcctccctggtgaccgtttttctgatacacagataatataaaaatccctctacttttttataaggaaaattaaccttctccccatctgcaaaaatcgtcggatttccacacaggttaatttcaacttttttcattgcgcctcccctgactctgttactttactgcccaaaccgccgctgtccgtcaaaaagaatatctgtcctgaacattctcccggaaggatatgccggtaaacagtactccgaaagactctgccgccaaatgcgggtttctactatgttctatatatgtttcagtatacaaaacatggcgtgtactgtcaactctgacgtagcagttcagactttagatttagttaagcaggtgaggacgccgccggtgcttagcgaggtccctcacgagcttagcactgcctcgcactccaaagagtgcaaacggtccccgcagcaattcattccggccggattccccctacgcgaccaacctcccacggggatggaagactcagcccgccccctcaccacacaggacatggtccgttccggacgcgtccccattctcacttaaatctccgacgtccaaagaagattggctggaatttttctataaaggacaaaattatcaattaatattgacgttttttggactctgccctgttataataggctcagaaagtaaaaaaacgaaacacagaaaggacgagataacaatgaacaatagtgaaatcggaaaagctatgacaattaaacttgatccggtactgccggagtatcccgtttttaaagaaggcatccgccgcgctcctatgagagagcttaccttatcagatcacgagaagaaactggctgtaaagaacgcgctccgttatatcccggaagagcttcatgagcagcttgctcctgaatttatggaagagcttcttacacatggacgtatctacggataccgttttatgccaaagggagaaatccacggaaaaccaatcgacgaatacaaaggaaactgtattcagggtaaagcattccaggttatgatcgacaacaacttaagccatgagatcgctctttatccttatgagctggttacttacggcgagacaggacaggtttgccagaactggatgcagtatcagttacttaaaaaatatcttgaggttctgacagatgagcagacccttgttgttatgtccggccatcctctcggactgttccattcccacaaacaggctccgcgtgtcatcatcaccaacggtctgatggtcggcgaaggcgacaatcctgagacatgggcaaaggcaactgctatgggatgctcctcctacggacagatgacagccggcggctggatgtacatcggaccgcagggtatcgttcacggtacattcaacaccatcttaaatgcaggacgtaaattccttggcgttccggcagacggtgatctggcaggccacttattcgtaacaagcggactcggcggcatgagcggcgctcagccaaaagctatcgagatcgcaggcggcgttggtatcgttgccgaggttgactactccagaatcgaaacacgtcacagccagggctgggtaagcttagttgctgaatccccggaagaagctttcaaactggctcatgaatacatggagaagaaagaagctatgtccatcgcattccacggcaacatcgttgaccttctggaatatgcggttgacaacaatatccacattgagcttctctccgaccagacatcctgccacgttccatacgacggcggatactgcccacagggtcttacctttgagcagagaacagaaatgcttgaccatgataaggagaaattctgcaaactggtagacgaaactctgacaaagcatttccacttaattcagactctggtttccagaggttcttacttcttcgattacggcaacgcattcatgaaggccgtatacgatgcaggtaacaaagacatctctaagaacggcgtagatacaagcgaaggctttatcttcccatcttatgtagaagatattttaggaccggaattattcgactacggatatggaccattcagatggtgctgcttatccggcaaacacgaagatctggttaagacagaccacgcagctatggacatcatcgatccgaacagaagattccaggatcgtgacaactgggtatggatccgcgacgcagagaagaataaactcgttgttggtacccagtgccgtatcctttatcaggatgcccttggaagacgcgatatcgcccttaagttcaatgatatggtaagaaaaggtgaaatcggaccggttatgcttggacgtgaccaccatgatacaggcggaaccgattctccataccgtgagacatccaacatttacgatggttccaacttcacggctgacatggctacccactgcttcgcaggcaacgctgcaagaggcatgagcttaatcgctctccataacggcggcggtacaggtatcggtaaagctatcaacggcggtttcggtctcgttcttgacggttccgagctgacagaccagattatccgcgagtctattccgtgggataccatggtcggcgtttccagaagaaactgggccagaaatgagcattctatcgaaactgttgccgagtacaacaagactttcgaaggaagcgatgccatcacaatgccatatatcgctgatgacgctctgattgagaaggttttcaaagaagcaactgcaaaataataaatccggcataatccgggaataatttttgacacgatatcatttctatagaggctgttgtttatctgcaacagcctctataagatatatagtaacaaatatctgctgattaaatccgcggtaggtaaactgctgcaatcatgagagaatgagagaggtttaatatgacaaagagatatatccgccacgcatctgagctggtgacctgtaagggacaggctccgaaacgcggcaaagaaatgtccgacatcggcctgattgaggacggcggcgtcctgatccatgatgataaaatcttcgctgtcggcacaacggaagaactggataagatgatcaatccggatgaatatgaaattatcgatgccacgggaaaaaccgtactccccggcttcgttgactcacatacccactttgtattcggcggttaccgcgccgatgaatttacctggcgtttaaagggcgacagctacatgtccatcatggagcgcggcggcggaatcaacgctaccatcaatccaaccaagaatgcaacggaagaagagctcgttgccgtaggccgcgagcgcctgaaccgcatgctggaattcggcgttaccaccgttgagggcaagagcggatacggcatggactgtgaaacagagttaaaacagctccgcgccatgaaagaacttgataaaatccatcctgtcgatattgtgaccaccttccttggaccgcacagtgttcttccgcagtacaagggcaaggagcgtgaatttatcgacatgatgatcaatgaagtaatgccgaaggttaaagcggaggatttggctgaatttgccgacatcttctgtgagaaaggtgttttcaacatcgaagattccgagtattacttaaataaagcaaaagagatgggattcaagctgaaaatccatgccgatgagatgttttccctcggcggagccgaactggcttccagaaccggctgtttctcggcagaccacctgttaaaggcatccgacgagggcatccggcagatggccgaatcaagtgtcatcagcacccttcttcctgccacggcattctgcctgaaggaagaatatgcaccggccagaaagatgatcgacagcggctgcgcagtcgccattgcctctgatctgaatccgggaagctgcttcaccaacaatattcctcttctcgtagcccttggatgtatctatatgaatatgtccatcgaagaggttatcaccgcactcaccattaacggagctgccgcagttgacagagccgatcagattggcagtattgaagaaggcaaaaaggcggatattatcttcctgaaatatccttccatcaactatatgccatatcacaccaccatcaatctggtggagactgtgattaaaaatggtgaaaccgtttaccataaagaatggtaatctaataatttgcaagctgtcaaactaccatacaaaaggcgcccgggatttattcccggacgccttacctcaatcttctgttttaagcgcccgcatcgcattcagtatcgcaattaccgaaactcccacgtctgcaaataccgcttcccacatatttgccattccggctgctcccagtatgagaaccagggctttgacggccagggcaaacacgatgttctgttttacaatcttaagcgtctttctggcaatcttgactacagtggcaatctttgccgggttatcgtccatcagaactacgtcggctgcctctatggcagcgtcagaacccatgcttcccatggcgattccgatatcggccctggtcagtaccggtgcatcgttgattccgtcaccgacaaaagccagtttgcgcttctcatccagaggctctaaaagcatctctactttatccaccttatctccgggaagcagctccgtatagactccgtccagaccgatttcttttgcaacggcctctcccacctcttttctgtctccggtcagcatgactgtctttctcacgcctaccgccttcagacgccggatcgcttcaaagctttcttctttaatcgtatcggagatcagtacgcttccggcaaacacgccttcccttgccacgtaaatgacagttccggcctctttgcattcctgatacggaattcccgcctgctccatcagtttcccattgcctgccagcaccgctttcccatctatcaccgtcttgacgccgtgaccggaaatttcttcagtttctcccagccggtttatgtcgatctcattagcatacgcatctttaatggaagcagcgatcggatggttggaataattctcggccagtgcggccagttccagtagttcttcttcgctgataccggacgggtacagctttgtcaccttaaattctccctttgtcagggttcccgtcttatcaaacacaatagtgtctatctctgccagagcttccaggaaattgcttccttttacaaggacaccgttcctggacgctgccccgatgcctccgaaaaagctaagcggaactgatataacaagtgcgcacggacaagagataacgaggaaaatacaggcccgctgaatccagcttgcgaacccctggcccagagcaagaggaggaacaaccgccagaagcacagccgcaatcaccacaagcggcgtataatatctggcaaaacgtgtaatgaaattctccaccctcgccttcttgctgctggcattttccaccagctccagaattctggacaccgtggaatcctcaaactcttttgtcacttctatcttcagcagcccgcttccgttaacacatccgctgattacctgggttccctctcttgcagacctcggaaccgattccccggtcagggcggaagtgtcaatcattgattcgccgctgattaccacaccatccagaggtatcctctcgccggcctttacaataatgatatcaccgaccgccacatcgtccggatccacctgatttaactggccgtcctgctcgatattggcatactcagggcagatatccatcatatcgctgatagactgtctggagcggttaaccgcgtaattctggaacagctcccccacctgataaaagagcatcactgcaacggcttccgaatattccttcacgccgaatgctccgaatgtagcaattgtcatcaggaaattctcatcaaaaacctgaccgttaatgattcctcttcccgctttatagataatatcccagccgataatcagatacggtaccaggaatacgattaatttgggccatatgccggaaaaattctccagaacacctgatttctcgctgattatggcaagaatgtatataataaaagccacaatgattcttgccagcattgctttctgctttttgttcatgctgcctcctgctgtctttcctgatttatatattgataacgcaatccggttctactttcctgcaaaccgcgactacttccttcataatctcgtcgaaacggttctcatcggcgtcaattgtcatcttctgtgtcataaagctgacattggcatcggcaacaccttcaattttcttaatcgcttcctccatcttagctgcacagtttgcacaatccagatctgttaatttaaatttcttcttcatcttattattcctccattatctttataaattcatgatagttcagataacatgaacttgctgtctgccatcaataaaactccgaacttaactgctgtcctactccttgatatgttcatatccctgatcaataatacttctcacatgaccatctgccagggaataaaaaactgctttcccctctctcctgtttttcacaagctttgactgtttcaggatacggagctgatgtgaaatagccgactgtgtcatattcaaaagctgtgcaatatcacacacacacatctccgcctcaaaaagcacatacaaaatctttattctcgtcgaatcgccaaaaaccttgaatatctccgccagatcatataaatcatcatcatccggcatcttttccttaactgcctttaccacatcgtcatggatctgataaaagtcacagcactctacgtcatgaattgccaatttgcaggcctcctttcatttattatctggttacagttcagcctttggctaaaccgtaacaaatgatgcacagaaacggcaaaaaaacgccgttgattgtggtgaaaagttcatttttcatcgcgtcgcgacgcacaactcgggattttcgcaaaaaacagcgaaaacacctcgcggaatacatcatggatgaactgttacattatctgtctcctcttaaactgtattgtaatacatattatcgaatatacatatgaacgattgttcatatgtatataatatgactcttttgctgagatgtcaagaacttttattaaaattaattgaaggatggagaacacatcgtaacttttcacggggtaatgttttgcgaggtgttttcgtgtgtatttcacacgaaattgagcggaattaaatccggcgatactcttccggccttaattccgctcaatcttttaaacatctattataaatctttctttctaaataccgatactgagatacagactgaaaccaccatcagaacaactgcaataaccggaatgattttcagcatcatgattatctgctccttctgaatctggggcagcctgtcacgaaacagcataatcactacccagggtaccatccagatgacaatgtttacatatctcgctttatcaatccctattatatagaccatcggcagcaaaattgcctgcatcagcacagttaccaccagtgcgctgcccacgccagcaagcagctccaccagaggttcccctgcccagactgcatatcctgccgccagaacaaaggctgctgccgccaatatcagatccagacacagcacaaaaatatatttagaccatacaagctgcttcctgctcaccggcatcgcggccagatattcatcgcaccggtactgcttatcataactaaatgagctgaaacaagacacaagccccagcacggatatcatcatcgtaatcatatatacgttcttaaagataataccgtatatgataaaaaatattaagacgaaggcccagcttttaaactgcggcttaaacatacaaaactccttatagagtaaacctttcataataaaacccctttctctcattcactgtgccgtcccggacggcccgcagaaccgttttctcaatacactgccgcattaccgcagcttttgtcttcggactttatcagaaaaagcatgatttcttccagggatgccgcttccaccacaatcccttcttttgatttgacaggactgttcgtcttaaccagagcttccgcaccaaagctgttctcccgcattcctgccacccggacaccgccgtcttcctccattttcatgatatcactgcggctgccttttaaaattctgtattcatccagcagacggtccttttcctcacagagcatcagccttccctggtgaatgaaggcagcgtaatctgccgtcttctcaatatcactgataatgtgggatgaaattaacacagaatggctctcgtccatgacaaactctttcaaaatatcaagcacttcctcccttacaaccgggtcgagaccgcttgtaggttcgtcgagaatcagcagccctgcattgtgggaaagtgcgatggacagggcaagctttatcttcattcctctggaatattctttaattttctttttgcggtttatatgaaacttttccaaatattgataaaagcaatcactgtcccagttcctgtatatccccctcatcatgctgtccacttccaccgccttaaacagatctggaagattcagtccttccatgactattccgatgttctccctcagcctggaattatcctcgcctatgtcttcaccgaacatccggatcgttcccccgtcccggtggattaaatttaacgctgccttaatcgttgtgctctttcctgcgccattctcacccatcagccccataatgcagccgtatggcagttccaggttcagatcctggagggtgaaatcactgtaatgttttgtcaggcctctgatttccagaatattattttctctctcttccatattcatcacctattaactcctatattcattgcctactgactcgtgtcctgtttcgtctccgactctctttgcagatatcggctcctaaaccggctaaccctcatcgtacatggctgccaatacatccttaagctcttcgcagggaatgtgggcaatcctcgccatgtccaccgcctcctgcaggcattcttcaatcttcttaaactgttcttccttcatcagttccttattctttcctgtgacaaagctgcctttcccctgaacggattcgataaaaccgtctttctccaattcttcataagcccgtttcgtggaaataaggctgacccgcaattccttagccagatagcggagtgacggaagcggggcccctgcttccaattctcctgaaataattgcattcttaatctggcttgtaatctgctcataaatcggcttatcgccggaattacttataataatattcataccgttatttctcctgcagtgcttgccgcttcgcgtattacgtcaaaaaataactcagcaaaacagctgtatatatactgtgtatgttaattatacacagtatatatacagctgtcaatctatttgtataaaaaatgcattacgattttctgacatttttggcagaaaattgcataaactctgttttacatggatcggctacttacgtttcccttctttttttggttgtttcgcgaacagatactgatttaaaaagcaaagaagaccgctgatcgatgccgccgggaatatcaccttcgtgactccctctaatgagatcataatttccggctgtccaatgagcagacagacaatctggcccgccacgtaaatgcatccacccagaaaaaagataagaaaaccgattaaaataagattataatataattttttcataagccctccttaacgcggcagcggtaatataccgaggcataccaaaactgcaatacaggtgattggcagaacaaaccatttgataagcggcataaatatcttcggcgggtcgcattccgtcaggccgcaggccacaaacagcgctcccgacgcaggcggtgaagctccctctgtggatgccacaacgagaatagcagtagccgctgcaagcggatcgatacccacagatactaaaatcgcatgggagataactccaatcgacgtgagtgttgccgtggaagacagaggaccggcaactactgccaccaggatcaatatgataacaactgttgcaacttttgacaggctcatggaatttaaaatctgtacaatatcttcagagaggcccagcttactgataatattgcttgccgcaaagacaaatatcaaaagaccgcctgtactggaaaaatgaggaattaattcttccacaaactgctccctggaatgaaatttttcccggatatccttccaccccagagccagaatgattgcgatcatcagaatcggtatccaaaccagtatattaatactgtcaactgccgctttccatacctcggagcggcccgcaatcaaatcagacaacggccccatattgagggctaccggaatgattgcccccaggaacagcagaagattctttccagccgtcttcataacgctgctccatggctcatccgttaccgtctcaggaagtactatatgattttttctgataatataatgaatataaacaactctccaaataacctgataaataccggtcaaaaataaagcaatgtaaagctgcccctcggaaacagcgcccgctacggtcggaaatgccagaacaataaacagagaggaactaggcgggaaaccggctcccaggcctccgttggctgctatcagcgtggcggcctgctctcttttccagcctgtcgataagagccactgtgccgtaaatgctcctgacgtggcggcgttgggagtgtttcctcccgacaacattcccagaaaagatgaaatcgccgtatttacataggcgggacctcccttcatctttctgaacaggcggttgaaaatcttcagcattccctgaagaacactggtgctctgaagtaaaaatgacatgaatacaaatgccagagaggcaaacaatacctcataactcagcgcatatttaattcctccgagcagaagctctgccgccctgcttccgccaaacagcgatacaacgatcatgccgataaaggcaacctctccaatattacgttttatgtatacactccaaattaaaataagtaagataaataccagcattgaagctaaacctggtcccatatgctcatccccttccccgtgaatttaaaccgctgtgtttaatcacaaagccggtcagtcggctctgtaaatatcatcaatcatctccacctgttttttcaccagcgtatcctcaacccactggcgctttgatgtgccatttttcgcggcctctacctttcctgcgtcaagagccgcatactttttagcctcctccagaataaccgccgcatcttttctcggtattacaatcacgccgtccctgtctccgagaatgatatcgcccggcattacggcaatattaccgattgataccggaacatttacttcccccggcccttctttgtacggaccgccgggcgtcgaaccggtggcatataagaacatatgcatccgggagagctcttcaatatcacggattggaccatccagcacaatccctgctatttttcttgtatgctgtgcatacacggccatgatttcccccatcagggaatgcgttctgtctccgtcattggagaccacgatgacatcgccttctccggccatgtcaagcgccttgtgaagcatcagattatcacccggccgggctttcaccgtgagggctgcacctgccatgattggaaggtccggtgagctgatcagtcggatttccgaactcagggcacaggagcgccccatggtatccgccacattagccgccggaagttgtttaaacgcctcaacaatactgctgtccggaagatttctttttaaaaacactctgtttcctacactcattctctctctcctcttctttcctgatatttattttgtaaaattcatttgctccaactgctccctcatcggcggaaccggatatttgggtgttcttcccgacagaaaatcgtcaataccctccgcacaggccagtgacgagcgggaagaagcctctttcgttgcagcgccaatgtgcggcgcggtcagtacattatccatctccagcagcggattttccctggaaaaaggttcttcccgggtgacatcgagggctgcccccgctatctgtttctcctcaagggcttttatcagcgcctcctcatcaatgatgctcccccgggccgtattgataagaaatgccgtctttttcatccctgccagctctttctcccccacgctgttcacagtttcaggcgttgcgggaacgtggagtgagacgtagtcagctttcttaaacacttcttcacggctggatacaggtataatataatccggcaattcttttgcataaggatcaaaggccagaaccttcatgtcaaatccaagcgctgcttttctggccacaagaccgcctatgttgccgacacccacgagtccgagggtttttccgcacagttcatgtttttcgatattgaatttagcaaaacggtaatcgtccttataaagcttctggaccagtttgaaatttctggaacagtaaagcatgtaaaaaaccgccagctctgcaacagattcgctgtttgccctgggcgcgtatagaaccataatccctttttcttttgcagcctccaaatccacgccgtcatagccggctccatgtcgcgctatcaccttcagccggtccgccgccgcgataatccgtctggtgattttagccgtcctcacaatcatggcgtcgcatccctttatatcccggatgatatcctcttcctcaaaaccgttcccatccaccagttcatatccccgttccagcagatacgctctgcctgattccagtattggctgtggaagcaatactttgtaccccatacatctatcctcctgttattattttttattctttctgaccctataatgagcaagatgcgtgccaattttaatccaaacgtatcagatatatatcagatgagatggtaattgcggaatcacctgataattttgagatttttgaggggttttgccgggccggtaatccagtgcctgatataaatgaagccgcactcttaacggtttcttaatttacacacctgatggtaatatttatactaaaacaaaatacatttcaataatgaaatgtatatttcacttcgtaatatcatttatgaaattcttctgccgtacctgttccggcagctcgttactgcagcaattatgtaaattcgcccgtacagaaaggaaagtacatggatactgttaaagatattgtcatatttgctccttccgaggcttttgcctcagccgccgctgagttaattcaggaacgggcgctttcaaaccatatcggcattgtggaggcgaccggaaaccggactctccaatacgcagaaaaactggttagggcgggcagccgtatctttatctcccgaggaagaaataccagcctattacagaaaaatataaccattcccatcattgacgtcccttatctctatgaagaaatttaccactctgtaaaggccaccggtttccctcccggcgaggtagcgctggtgggatttgataaggcatttcagattatgaacaggttcaaggatatttccggacaggacattcaggtgatcgggcctgattcgcctgccactacggaaaatgatattctgcgggaattgcgccctggtacaaaagcccttattggaggattttccgtaaaacgcgccgccagactacacagtcttaaaaacattccgcttatggttgatccgtgcaatgtatccctcgctatcgacagcgcgctgaatatcctgaccgccatggagcataaggatgaatatctgagcgtaatatccgccacggttaaccgaatttcaagcgctgttctgaactatgatacggccgggaacctgctcttttccaatgagaaagcaggcttactttttcaggagtttaacacggaacagataaaagagcttctcttttcagacagtgccggtgactatttcagcctggagcgcagaagggccaatattgaacttaagccggtacacagccaggaaagaattatacgcatcggctctaaaaattacattgcggaatatctgccggtggtcgtaaataaaaaggtaaaaagtattgtaattattatttccagtgaaaacagcattcagtccgcggagaagcagttacgcctgaaccagaacgcaagaggatatgcggcgaaaaaatcctttcacaatattatcggcggcagtcctgccataaaaaacacaatccgtctggctgaaaaatatgcccggtcacagagtgcggtcttaataacgggtgagacaggcaccggcaaagaaatttttgcccaaagcatacataaccggagttcccgggcacaggaaccatttgtcgcaattaactgcgccgccctgcccgactcattgctggaaagtgaactgttcggctatgtaaaaggagcttttaccggtgcaaaccgggaagggaaaatgggtattttcgaactggcccacaagggaaccgtatttttagatgaaataggggaaatggatttgagtgtacaggcaaagcttctgcgtgtacttcaggagaaagaggtctgcaggctgggcgacgaccgggtgattccggttgatatccggattatcagcgcaaccaataaagacctctcagaactggtccgtgaaaaagcgttccgtgaggatctgctctaccggctgaatgtgctggagcttaagcttccgccgctcctgaacaggcggggcgatatccccctcctgattgaggcttatctgaaaaagctgaattatcccgttcatttcagggaagatgcagtcagcctcctcagcttcggctcttatccgggcaatatcaggcagctctttaacctgctggaacgaattgtgactctggctgaaacagatgtaatatccgcaggggatttggaaggaatcgtttacgggataactgccgccaaaggaaatggcgcgggctgcgatatgatggaaaccgctatggaaacggatttgaatacaaagccaccgggaacccggataaaggcagaaagctgtgataaaacagaattgcttgccagggccaaaaataagcccgcactgagtcaggctctaaacaactgtgagcagcaaagaatcgaggaatgcctgcgcaggaataacgggagcagaatcaagacagccgtggaacttaatataagcacggccactctatggcggaaaatgaaaaaatatcaaataaatttatactaaagaccgccgccattaaaacagcagaaccggacgttaaaagtgtagttaatatgtccgtttctgctgtttcacctgctagtccgcctgtttatttccctgtctccaggaagttcagaaatgcttcgcaaccctccctgatatcctcataggccgtgtcaaaatcaccgctgtaccagggatccgcaatgtctcgcggacgatcggaaaaatcgagaagacggtatacctttccttttggatctccgccgagtatccgtttcatattgataatattgcgttcttccattcccagcagataatcatattcagcgtaatcactcttttttaactgaactgcccgttttccgtcacaggaaattccgtgctcctgtaatttccgcctggcaggcggatagaccggattgccaatctcctccgtactggtggctgcggatgcgatataaaatccggcgctgtcaccgcgttttgtcaccatgtcgcggaggatgtactccgcaagcggggaacggcagatgttgcccagacatacgaaaaggatcttaatattattaaattgcttagccatatattatatctccgttactttttaataactaaagtctactataagttcatactttgaacaagtatttcttatgataggtacaaaaaaatagtcacccgcctaccaaagcaaatgtgactatcctttcatatagattccaatcctattggaatgctgcaattcgtttattacaacttcagccctttactcacatttaccacaaaatcctggacattggtaacgatgctcttggccgacaggctgcctctgtctcccatcttattcaccgcaaactcggatatatccaccgtataaaaatacacctggcggatcgtcccgtccggcatcatacggaaagacggggtcatattgcccgttgcaacggagtggagggtcgtcgccatacagatgactgtcgtcgctttgctgacacagcgtctcatggcatcctgcccttcatatacatttgcgtaaacctcaggcagaggtccgtcgtcgcggatggaacccaccaggacaaagggaacttcttttttcacacagctatatataatgccgttatcaatcccttccttttcgataaaggccggaatcgagccgtggtattttaccttattgatcgtatcgatatgattataatggcctccctggtaactatgctgggtatagatgtcctgaccgagggccgtctttaagtaggcgccttccagatcatgggtggccagcgcattcccggccagcagggcatccacatagccattcatcacgagcttggagaaggctgcccttgaatccgcatcgaaggcacaggccggtcccagcacccagactacatagccgtgttccttctcatattccagaagttcatagatgttatcgtaatcacgcgaaaatgccgtttcccttgaccggctctgccggaaagcaaatgcctcccccggcgcctccacgccgtcctgccccagttccctgaagccgtcaggatatacaaagattccttcctctccgtcttctttcctcccggtgaataccaggtcacccttttttaagtttcggaattcacggacatggattttcccattctcaaataccgccacgcagtccatgcggctttcctctgccagcagccactgactcccaaccttaaaatactcgggaaatatagtggtggcgtgatacccgtccggagcaactttatcaaaaggcgccggttccagtcttgcctccggggcgttcatcagactgggctgtgtaaaatccggggcctggtatgtttttaatttgaatgacatgaagtatcctcctcgttatgatttaacttataccaaagcagtatagtaccgccgcagtggacctccagccggccgatagagttttctccaatactttaatatttttcaatccggcgctgctttctcagctcattgcggcgttttcctgattcccaggccgctttttcttcttctgtctccaggataagccccggtacctgaacggggtgatctttttcatcgagggcgaccataacaaaaaaggcggtattaaccagctttctcgttccgtccagatcttccacatagctgtctacctgaacctccatggaagtgtgtccgacgtatgtgatcttgcccagcaggataagcgtgtcattcagacggaccgcctctttaaactgcaggttgtcgaccgatgcagtagtctggttgcagtgggagtgcctgcgggccacaactcccgccacgatatcgatccactccatgagctgaccgccgaacagccgtccggctccgttgatatggctgcttagtacaatctgtgtctgtgtgaccgcggagtccgccacgcgccgcataggtttttgatccatatgatgacctcctttatactggaatgtatattagtccagtataatgttttttagggttatttgcaacttgattttgctgcttggcagctgttccgtttctgttttcgggattctccgcggagcggtttttatttaacaggaaaactttccggttaaaaaacgccggtttctctttgggggagtagaaaccggcaatctatttacaccctgtagtaatggggatgtaagcgtaattcaattttcagtattatacaatcagtcccatctcttttgcctggaacgtcagctcgtccctgaatttgggatgggaaacccttatcagctcttttgccctctcttccacggtttttcccgccagaacggcggctccgtactcagtgacgacatattcaaccatggtacgtgtcagagataccggcgttccctgtgtgaaggacggcacaatcttggaatattttccgttttttgttaccgactcgacgaccacaatggactttccgtccgggcaaagcgcggctcccgaagaaaaatcggcgattcctcccatgccggaatactgttttcctttcaggtattccgagttggcttgtcccagcaaatccacctgtacggcattattaattgctgtcatccttctgttctgcgcgataattccgggatttaacacctgctggcagctattcatattgagtccctggttcccgtcggcgaaatcgaacaattccctggaacccaccagctgcgcacagacagagacacccggatacaatgtttttttccggttggtgacaatgcctctctttgtcagttccatcagcaggtcgccgtaaatttccgtatgaacccccaaatcctttttcggctccatatacatcatggcggaggaattcagccgtcccagtcccacttctatcgttgcctcgtcctctaccagctctgaaagatatcctccgattgcctggtaaatctccctgctgtcctccgaatcatcaattgccctgatattgagaggataaccgtccccctccacaatatagtcgaattccgaaatatgtttcacattggcgccgagtacgaacggcagctccgggttaatttccgcaatggcgagttctgtctgcgtggagatcaccggcatcccgtcggccgcatttcccattgagacatatccgtttttatcaggttttgacacacagggcattgcaatcctgcattttaaagtattcacggacagttttccatatcctgaaaaattacaggggacaaattcggcgcggccgtcttccacgaattcccgattcattccgtccatgaagctcaataaaaccttcacctcattttgaagtcccatcagttctcccaggaagttggtttgagaacaataatatgtcacgttttttaaatcttttcttttccccagttcccggaggatcgtcttcggctccctcgtcacggcgcagaagctgtcgccgttttgcaccatagccgccgcctgtgccgccgtaatcagttttctattatagatatctttccacgtctgttccattatctttctccagtatacctgtcttaactgttatggttattcttccagtccagagccgccttcagtccctggctgttcacaatctcattaaactctttctgtgtctgggcctggttgatacggcacaggctgaatatttccgccgcaaaatccatggcattaaccattccctgaatctcataggtcttgttgacctgatatttaagcatcatcattgtgtccgaaggcatttccgcaagccgtccggctattttcatcgtctcctcttccagtttttcaaagggaaccaccttatttaccactccgcactcgcggagttcttccgcagtcaggtattcgccaagataaagaagctgccttgctttattcatcggaagtttccacggctcgatcagaatgtcggggacatacgaaaatgcaacctccggctcgccaaaccttgcgtcctccgctgcaataatcaaatcgcacataaaggcgagatgcagaccaccgccgatgcagaagccctgtaccgatgctatgaccggctttttgcacttccacacctcacgccatgtattcagctccatcgccgtattctctcttctcggaatcacatcgacaatcggttctccgatgctttctttaatatcaaagcctgcactgaatgccttatcacccacggcgctgattacaatcacgttcgtgtccggatcctgatccgccagcttgataaattcgcccagattttccaccagctcctggttgaatgcatttctggccttcgggcggttgataatcacccggcctatttttcctgttttctcatataaaagtacatctgtctgactcatttttcatatcctcctgatttttcttcttattggttccaccgcccgttatgtacacggctcccgtcccacctgtcctttgccgtcttcttaaattccggatatccgaaggacagcaggcagaatatttcaatctcatccggtatatcaaataccggcctcatcgttttaattctttcttcgttcgggtaaactcccagccatacggctccaatccccagatgctcagcctccagaagcatattttccgccgccgcagaacagtcctggatccagaaatcaaacctgtatttctgaagtgacgggtctgcgcacaagatcacggcaaaggcagcttccggcagcatagccgcgtggggatggagctttgatagttttatcagttcctcccgttcctccaccaccacaaaatgccacggcttctcattcccggccgaaggcgcacacattccggcctgcagaataagccttattttttccggctcaaccggcctgtcctgatatttccgggtacttcttctctcaaatatctctctcatatcctcacgctttcctctgcaaacagggaagcggggccgccggtaagaatgtagattaccggcacgcttctgctttacccgcctccgctccatttttccggatccagtttatccatgaatgatttcacggagcatgcaggttatcgtttagctgcctccttcggctgcgtcatcaggcttacaatgatatacgcaatcagggacggcagaatcgggaaaatagaggagaccggaagctgcactccgcaatatttgtagaggataacaaataacatgcctgtgatggaactggcaattgcgccggcctttgtggcctttttccagaatattccgccgacaaacataaccagcgttccggcacacataaaggtataagccgccgacagcatggagataatcgtctttgcccccaatgccaggtaaagcacgataatgccgattaaaaaggttgcaacatgggcaatcctgttgagctttttctcgctggcattcttgtcaaaatatgctttataaatatcattggtaaatgaacccgtcacatagattaactgggaatccacagttgacataactgctgccatcagtgccgcaatcataagggccgctacgagcggtgggaatgcctcaatcagaacatggaacaaaatcgttccaggcgcagcatccgggtataaagcaatgccgtacataccaatcatgaccggaagaaccacatatggaagcaggatcatagctccccaaaatgcggaatgaaatgccgttttttcatccttacaagacatatttctctggaaagatgcactcgaaatcaggccgtacagcatggacggaaacagcatcataacccatgtatctatttcaaaaggtatcagctcataaaaagagcttggaaggacttctctcatcaggcccaatcctccctgtgacaacatgcatccgaagactatcaccgtacagaagaaaatcacggcaacctgaatcatgtctgtcatcaaaacgccccactggcccgacatcgttgaatagataaaaacgataatacatacagccgccgcccccagcgttgcattcattccgaaataggagaacaggttctttcccgcaataatctgtccggccataatactcatagccgccaaagcattgaacactgcaaaaatagtaccggtgattctggctccgtaccggtgatttaaaatatccgacattgtcagttgttccgaacggtaaagtctctttgataaaacaaaagcaaaaagaacataacccaaagccgaaccgacaccgtaccaaatccctccgattccataaatcgcgccgtactccgcgccgcccactacaataccgtttcctatatgggaaccgatgtaggatccgcagaccataagaaatgttccctgtttcgccgccgtaaggtaatcttcaaatgaattggcatactttttgccataaaaacctacagccagcattcccccaagatataaaaccataactacaactataagctgtaaaatattcatacccttcctcctgtatttcacaaatataacttctcttcagtgtaaatttcagacagcataaactgttgctcttcagtatcaactgtccgccggcatgtctccggctttgccttctgcccgctctcctccggcgtatgcgcagggttttaatgcagaatgctgtactttttcaccagttcttcatcaatctcaatcccaaatcccggcttcttcggcagaggaatgcagccgtctttttcaacaaaataaggttccgacagaatcccctgaaatgcacccggcgtaagtgtcggcggatcatatgggtattcgagccaagtaaagttcggaatcgacgcaaccatatgcatgctctgcagcactcccgtacccggtatgtaagcatgcgggttcacggtctttccgtatgaatcagccagggccgctatcttcctgatataactgattccggtactcatcgtacagtttggctgtaaaatctcatagcatcctttttccagcatgattttaaaatcaggtatgcctatattaatttcgccgcccgcaatcggaatatccacttcttcattcagctttgccagcccgtcgaaattatatctccagagcggttcctccagccatgcgcagcccagccgctccatttccctcgccgtatccctcgccctctcataactccagacatagggaaagccgttattgttccgttcacaggcggttccctggttggcatccaccatgatttccagcttatccccgacggcttccctgactgcctctacaattgcaatatcttctcttatcgtttcatgggtaaaacgtatttttactgctttaaatccctcctcaacgagccgcccggcatcttcctttctctgtttattcgaacggatttccccccaggctgcataaaccggaatccggtcacggcaggctcccagaagctgacagaccggaagccctgctgcttttccgataatgtcccagcaggcgttctcgattacccatggtctggtggcgattcgggctacattgcgcagcttaaacatgattttttcaatatcaaagggggagtcgccgattatcatctctttcgcataatccatcgttgcgcagaccagcttcaggattccatggggcgcctccatatttgcatagccggttatcccttcatccgtgtgtacacggactacgaagatgacctgcccctgttccgtttttcccggataccaggtgggatggaattcctccggaaaagggacctggacacagtcataggtaatatccgttattttcatctcaacctcctgtcattgtacatttaatcttttttcttgctttttattatcaacccgggttttaattgattttaatgtgttttatcacttatttacagtctttttacttgactacattttagcagaaacatatttcaattaaaaacagtattttttttacactgttacacctttttgttgtatatccggcattcctgttcacaggcagtatcccgcttgtccgcagcacgccgcttttggcgggggggtgaaaataacacactacgcgatgtgcagaaacgaaaaaaacgccgttgattgtggtgaaaagcagctccggcttccctccctgtaccggcagaagacgaacccatagcatttagcaggggagttatggtataatggccgcatagcgggcattataccgcgcataaacggtttctgcgtttaccgcagaaatccggcgctgttttccgtcggagactccatgttccttgaaggaacatggtatattggcctcatagcggcagttttgactttcatcagaaagaagtgaagatatgaacatacggcagttagaatattttgttaaggtctacgaaagcggcagcttttttaaagcagcggattctcttttcatctcccagcaggcattgagccgggctctggccacgctggaacaggaattaaatgcacagcttttttacagaaaccataaaggcgttattccaacgccgcttggacaggaactctatgtgtcctgccagcctgcgctaagggagatgagaacgcttgaaaagcacatgaacgaattcgtccgtcagaactatggctgcctgaaaatcggtctgggcgccgggtgccggtatttcatatcgaaaaccatgtggaaagacttttttaaagattacccccttatctcttatgacgtcgaagagtacacctaccggcaaagtatcgaacttctgaataacaaggagctggatattttaattatttcggattacacaccgggaaaggaatattaccagtatgagctgaaaacccaggagcgcgtcctgctgcttccgaaggaacatcctgcgcttcaggaggaatatgccgaattgcaggacttaaaggaggagtcctttgtcctgtccattaatgatctggcttaccatgattttacggaattctgtaaaaataatcactgtcttcccaaagagatcctgcgtgtcagcgatacactctatatgtatgaaacctgcagccgggatcgctgcgcaggaattacaatcaagggatattttaccgatgtattcctccccaaattcccggacctcgatataatgccgtttgagcacaatctttttccctacaccatcacgctggttgccaggaaaaaccatcccaacctggctctcatcatgtccctgtcggcttatttgaaagagtatctgagtgataaatcttagatagctccggataagttgataataaattaacatttttcatcttgcatttattctccatttatactacactttctttgatgaatgattacatataatgcagtttttatgttactgttcacaggtagtgtcccgcgaggtgttttcgtgcatattctgcacgaaaatcccgagtttcacggcgcgacgcgatgaaaagtgaacttttcaccacatacaattgacaaggaggaaccaaatatgaacgcaattcagattaaagatggcatttactgggtgggggccttagactggcacctgcgtaatttccacggatatacgaccaaccgcggagccacctacaatgcctatctgattattgatgaaaaggttgcattgatcgataccgttaaggccccgttttcccgggagcttctggagcgcatcagcagtatcatcgatccttcaaggattgactatatcatttccaaccatgtggaaatggatcattccggcgctctgccggccttgatggagacctgcccgaacgcaacggtagttacaagcgctcccagcggagtaaaagggctcaccgcccactacggccctcacaattatatggccgtaaagaacaacgatactttgagtctcggaaaacgcagcctctcctttgtcaccacaccgatgctccactggccggataatatggtaacctggtgcccggaggaaaagatacttttctccaatgatgcattcggacagcattactgcactaacacgcgttttgacgacgattctgatttctgtgaaacgatgcaggaagccaaaaaatattatgcaaatattatcatgtgttatggaaaacaggccgcaggtgcctggaagattgtaaaagaaatggaaccggagatgattgcgccgagtcacggcgttatctggagaagccatgtggccgatattctgaatgcttatgaacactggagcagcagcgtaccggaggccggcgccctcattgtctttgacagcatgtggcactccacagagaccatggctcagaccatagccgaagcgtttaccgaaaagggagaaccggttaagctgtttgatttgaagcagacccatatttccgatatcgttgtcagccttcttgactgcaaatatgtcgccgtgggctcgcctactctcaacaacaatatgcttcccaccgtggctgcctttctctgctatatgaagggcctttccccgaaaaaccggcaggcattttccttcggttcttacggctggggcggacaggccaacggacaaatcgaggaagagctgaagaaatgcggttttgatatctgccttgagacgctgaagatacagtatattccttctgaagaacagttgaaagagctctctgaaaaaataaaatccttaaagtaattacatagcaacagttcgctatgctgccctttttcacggtcagcgcaacaaatgcgctggcctgtccggactgtcgcagcgataacctgcacgctccgcgcacaggtcaccgtcatcaataaataagcaggtgaggacgccggccgtaccgtcagcgtcctcacctgcttatttaaccgccagcatttctatatatcctctgcttcccaccggctcaagctggattctcggattttcttcatcccacctgtatccggttaccgacggatcgtatctcctgatcgcctcttttacctcttcaatcgccaggcaataatcctcttccgcaaacggctcgccctggaacatcatatattttgcagccggcagctccagaatctcaaaaccttccggcagggccccgtcataatcagcaggaacctcgactccctgaacatattccgaagttcccggtttaatgtatttacgcgggagccagaggcagaccggttccccgctgatggatttaatgctctgaagcagcccccatacatcgcatccgacctcctcacaataagcaaaataatccgaggctttcacccccctcttgattatcactctgcgctccggtttctgaaccacctgaataaacacattttttaaattttccatgcctgctctcctttcaatatatctgaatttaacgccgtagggtgtaaaaagatataaaggaaccggatttgctgcatagtccccgggattgcagccaaactcccgcaaaaatgccctctgatatccgtccacgctgccaaagcccatttcgaacgccacatcggcaatcttaccggcgtcatccctaagcttcagcgccgactttgacaaacgcatccgccggatatagtcagccggtgtggtacctgtctggcgggtaaacagcctgtaggaataccacggggaaaataatgatacccccgccaaatcggccagtgttatctcttccgtcagatgactgccgatatagtcctgcatacgctgcaccgcatcaatctgttcctgcatgtctctcacctccctgtctgacattataaagtgataaaaagaaaagctctcgactatttttgccttacgctccagcggccggtccctcctggcggtcggctgaggcagctgctgcctgttcccagcaacagaaaaagcagacaccgtattctcctttggtatctgccttttccccgtcctgccttcacaccggcccggcggttaccgttacacttcaaaatcttcccgaatcacttcccatgccgcatccacgctgaaatgagctttaatgtactcctgtgtcttttggctaagctgtgcaagccgtttctcatcaccgtaaagcttcactaccgccccggcgaaatcttccggtttatcctccaccagcagcacgtcttcgacacccggaatcccttcgcttcccacagaagtggttactatcggcgctccgttataaatggcctcgactacctttcctttgacgcctgctccatatctgagcggaacgatgacaatccggcagctccggtaaagctccgacagctcctcctcggaaacaaaccccttgacgataattttgcttcccggctgctccaaagctttgatttcatcggtcaccctggaaccgaccacataaaaattcacatccagtttctcccggatcatcgggaatacctcttttgcaaaccacagaacggcatccgcattcggcggatgggcaaatcctccgacaaacaaaagtccttccctctttgcaaagtcctgattcagattatccagaaacgtatcgtacacataggcggtaattgccttcacatttaccgtctcatccacatcatggattgcttcctcctccacaacagacggatagtaggatacggcagccttatgcatcagtgagaattcaatcgacttccagtattcggaatcacgttttttccctatatccccggtcagctcatattccctgaattccctcataaaatggagatcatggccataataaataatcttaatatccgtatgctctgcgatataatccacatattttgcagcgatatgaggacggttcagataggcgatgctgatttcttttccatttttatcaagccagtcccagataccggtcagatactcctgtccgtacagaacctcgattcccatctgctgaaggactgtggtatatggctcctcgtgaagataattatcgcctaaaaattttaccgcataccccttattcaaaaacatcttcagatactggaacgttgttttagaccctgcatctttatcaaatgtcggaacataatgatccaccaccaggataatcggttttcccatacttctctccctggcccggaaggggttcggactgccggtattcacgcactgcttcttaaattcctctttccatttttctttcagcttttcgctgttctccacctggtaccgtttcaggccggaaccatttacatccgttccgttggagacgccctcaaaatgaatcaccttggaaagcggctggtagacgactctgtatcccgcctttctgacctcaaaagccagatccgaatcctcacagtaggcaggagcaaaccgttcgtcaaagcctccaatccggttccacagttcagcggaaagcagtatcgcggcacccgatatatagtccacatcttttacataattatattcggccttgtccggattatccagacggccgtaattccatcccgaaccgtcgctccagatgatgcctcccgcctcctgaagacggccgtccggataaaccagcttggatccgaccataccgatagagtcatccgactgaatcagactgaccagcgaactgagccagccctccgtcacctgtgtatcattgtttaaaaacattatataccggccccttgcagatttggccgcatggttacaatttcttaagaatccctggttcgtttcattccggcaaattgtaatcccttcggcaaattctcccagatgctccgtcgcatcgccggaaacgtcatccgcaatcacaatctcatagctcacatcctttgtatgctccagaatcgatgcaaggcagagataagtataatggatctgattgtaaacgggaatcacaatcgatacttccgggctgtctgccttcgggaatatgagttttccatattgcaggtactcttctccgatctcaaaatcgcccttgattctattttttccctccccggatgtatacattccaatgtactttaccgggtgaagaagagtattcttgcagtaacccagaatcttccgctttctggtccccttcggatacattttattaaatgcctgcccgattttccttctcaccttaaaaataatcgcttcgtggcggtttaaataggtcagtgttttccccatctcaccgatttcacggcgcagatcgccaataatcacctcaagattagccacatggttattcgtcaggcgctgtacctcctggacttttttgagggcggtgtccttctccgagatttcagccctgagctgttcgatgcgctctctggcccgcataagctcaccgtccacctgacttagctctgcgaccgtcttggtctccaccatgaaatcttcctggtacgttctctggttctctccgtggacatattcctggaagctcctctccattatttcataaagcgggagcatcgtctcatcaatgtcgaattccttcaggaactgagcctggttttcaaactgcccgtttatcaggctctgatactgtctgtaaaaataatggagtgttctgtaacgcacaaaaccggccggaaccgggaaccggaatacccattcataatccagggcatagacaccatcctccgtcaccagcatattttcaaaaagagcgtcgatattggaggctctgtaagactgctccggctccctcctgtctgaggtccgccatttaagccgctcctcatcctccgaactcaattcacccgtcaatccgaacacttccatgaattccggcgttacatggaaatccgagatatattccggacggatgtcatagataagctccatgcctttcttcactgcagggattatcactcctgaattaagttcctcccccagaagctccgccagcgtctttccctgcaggtaatcaaaacgggccgttctgccgtccttaacaagctccggctttaccagaaacaggctcccgttctggctggtcagaaaattatatttttcctcaaacgaacggatgtgggggattccctcttcgcacagggctgtcttttctgcaaaacgcactccggcttcttccataatctgcgtcttaatctgaaatttttcccgcctcgtcctgttatattttacaaatattagctctgccattgccgtctattctccttcattcttatgagcgctccaaatcacgaggaaggaatttgcaaaattctcaaactggccgtcctcacatacggcgtcgtaagcggcgcccacatccatcagcaggtactccgggtagtcataaagcgccggcattcccgtcaaatcgccttttttcggcagataccgatctgaataaatgacagacggcagtttgtaatccggcatcggatagtaaaaactgccccctgccagaagttcctcaagattctttttggtcgcgctcaccgcatctctctgcgtaccggcgaaatatttgagtccgaaccggttgcagacggcaagaataatggttccgcccggcgccagaagacgtttggccgcctcaatctgtgcgcccaggccttcgctgccgtttggccggccgataagtagcacataatcgaagctgccgctgttctccttctgtctgctgtatgcagtcagactcccgcattccagccgaaggccggtttctccccgatacctgcgtcttacgacttccaaactttcctcggactcatcgagaaccgttaccgaaccggttttacgcagatacagaccggtaagcgctccaaaatcagcgcccgcctgaagcagtcggccgccttttctgaattcataccactctaacagattttccctcagcggagccagggcatagagatattccagctttttattttccttcagagccctctttgtatcattgccgtatttatcaagcagcgcgagaatttcaccgttagggttcttcttctttatattcttcttccactcttccatctaagttcctcatgcattgcagattttactcttgcaccagatgtgcttccacttccggttccatatcgtaaacgcctaccgtattcttgttggaaatcacggtaatattcgccacatcataaagccggtggtataccacatgctctccgttctcaaagccggtacagctcatggacagcaggtattccccgccctggagcgtcattttctgtgtgaaggacacctcatagacatcgccctttttcaccggtttaatatccgttccctcaaacaaggtattggtaccggttaaatcgctgcccttcttatccttaattgtgtacgtaaagataggagcctgtatctcctggttaaacctgattttttccttaatcgtgaacatctcgcctttcaaaagcaggtttgtgatattaccccgctgatcaatcaggcccatatcaaagatttcagcccttccgtctccgtactcctcacggttggcattaatggtcagcttatcccgcatcagcgacgggcctgccgtctggccgcctgctaaagccctgtctttatcctccgctttggtttccccgctgcctgcctcggccagtacgatcttctcacccgaaaaatcgttcatcctggtaatctcttcccgcagcgcctccatctggccggccaggatttttttgtacatatcaaccatcttgccggcagaaccttcggcaataaattcgcctctgtttaacagaataaccttatcacaatattttataatactgcccatatcatgggtaaccatcacaattgtcgttccgttcttccgtatttcttccatccgtctgtagcacttggactggaaaaagacatcgccgaccgacagcgcctcatcgacaatcagaatttccggctccacgttgatagcaagagcaaaggcaagacgcacaaacataccgctggaatacgtctttaccggctgatagacaaagtctccgatatcggcaaaatccagaatatcctgaagcttatcctccatctccctgcgtgaaaatcccatcatggttccgttcatataaatattctcaatcccggtgtaatccatgttaaaaccggctcccagctccagaagggccgatatcttgccgttcaccatcacctcgcccgatgtcggcgtcaggactcctgtaataatctttaatatggtcgatttgcccgaaccgttcgttccgatgattccgacggtctgtcccttttccacagaaaaagaaatcctgctgagggcatagaaatcccggtgatattgttttttaccgatattcagtgactcctttaaacggtcgatgggttgttcatacagccggtatatttttgtaacatcttttatttcaattgcattttcagccgccatggtctcctccaaaaaagcgtataatcggttatattataacatagtctttcccattttcataccggtaaaaatttcagcgcatcggaaccgtaaaataaataagcggacggggtggtggggtggttttgtgagtatttcgtccccgggagattgtcgtgggttgggactgcggctgctgagcgtttctatatgggatagatattgttggatgtatgatagatatggactgatgttgttgtttgagtgttgttgttgggaatttaatcgatttgatgtttaaatagatgagcggaattagggccggaagaggaataccggatttaaaatcagcgtcagaagcgggccgggtccggtgccgcgaaaatcttcgcctgcgtcttatggacccggcaaaaacctgaaccggggaagtaggccaaatcaattgcagaggggacatgggaatccgccaagaacattcctcaatctgcttccataagggcggccgggttttcctttatcatcatttcaatctccgtttccttaatcccgtgctttataagcccctctgcaaattctgtaaggcctcttgccgaaccgggtgaattcaactgtccgaaatcagtaaccagcaggctgtgttccggcccgttttccctaatctgggcagacatctcctcccagctaatccggttatggtaaacagtaaaacaactgtgttccacgaaagctcccagctttatacattccttcctggcctcggccgagaaccgggtagccgggttttcggcatgggtcagaaccaccttcttcacaccgcgccggacggcctcacggaccagcataacgccttccttctcacccacatggcccgttccgactatcaggccgtacctggccgccacatccagcacatcatatgctccgtgaagcagccttcctccatcctcgcatacctgaatacaggatgaaagttccgtatccgtgccgcctccctgatggaattttctgtaactcagggaatccatggtgggaaaccagagatattttcccccggcctgggccatccgttccgccgcgtccgggttcaatcctcccgcctgacggttcagcaccagccctccgtacaccttaagtcccgggaaaagcgaacgaagcattgcagcccggcctgtggtatcggcataatggcacttgattacgcctcccttcataccggcgccgctccattcctccgccagctcgagatccgtatattttctgggaacgacatccggagccgtatgaaaatgtaaatcccaggccccatttaacagctctttcatctcatgcctcctgtctgactagtatggaaggaaaatgggaatcagggccacgacgaccacataggtaagcagtaccatcgggacgccaatcttcacaaaatccatgaatttatattttgtccagccgaccgtcatcatattctggggagcggcaaagggcgttgcataggaagccgcaccggccagagttataatcatggcaatcggatatggactgacgccgattttttcggcaatagagaggccaatcggcataaatacgaggatcgtcggaatattggacataacctgtgtcaaaagtaccgccgcaaagaatatgaccgtgctgatcatgaatgcgctgggctgttcaccgagaatccgtataatcagattggcgacggcatcacctgcgccgcactccttgataccagaagagatagcgcttaaggctcctacaagaatcagacagttccagtcgattgccttaacagcgtcctttacactcatacagccggaacccacaattaccagggctcccacaaccgccgcaatatgcatcggcacctttttagagccagaggctatcacagccagcacacagaacatggtaagaccgcagattacagccttctttttatcaaattcctttttctccgtctgggcaaattcaggaacatatccggtatccggcagcatcttactgccaacaaaggcaaagaagagcgttccgatgatgcagattccgattccaaaaggcgtgatagagaaaaagccaaacggttcatatcccagttcctgcatcacaccggccgccgatgcgtttgaacctacgcctaccagagtgacaaatcctccgaactgggagccgaacaacagcgccagcagcgcctttgacggcccgtaaccggcagagatacacatcgcggtaacgagcggcgccattgccaccataacgccgatattgctgcatacggcgctgagaacgcaggacacgataagcgttgccagaataatattcctctcactttttccggtaatttttaccatcttttctccgatgatatcagtcacgccggaatggaacagggaagatcccaccaccatcattccggccagcagcacaatggtagtactgttgtaaccgctgaaaatcgtattcacttctataattcccgtataggcatacaggatggaggcgccgatggccgtaactacaattggaatcggctcccagataaacagtgcgatcgtgaccgcaagaatcaataacgctattaacatgctattcatgtaacatttccctttcagataagttttacaatttttccggtgggctgatcagcattacaacgcaaaacaacaatacagatagtatcggcacgtctgccttctgttaaatttgaacattcctaagctcaatgttcctgtatgtttcagcaaattgattatagcatgtcgtatttacaaattaaaacaagattattttactatttccacaaaaattctttgtgaaaataaccgccggcccggtttacttactcccgctgaaatgcgcccggtactcaatccggcccgcagcatcatcaaagataaccgtcactgaaactccttccggataaaccataccggaaaccgtatactccgtaccgcttttcgtctcactcttttggcttagggcgcggagttccgatatccgctttttctcactttcaaactcctgctttggaaggttccaccccgcctccatctcccatgagtcttcaaacagcgtggaaaatttactgtaatggtaaaccgcggcctctgcggcctccggaacggcagccggaaagcaaacggcagcggcccgtacgctgtcctccacatccttatcgactttcatataagccgttatccgggatgtggcggaacaaaacggcgggattaaaaacagggacaccgtaccgatcaggcccgccagtacggccggaaccagcacgcctgaaagtacccgggtgagtattttcttccgtcccggataccgtttcatgatgcaaaggttgaccaggcttattacggtcggacacagagcatacagtataatgaagatctggagaaatcctttataatccagataaactgatggatatctcaatccgtatccaaatattacaacagccgctgccaggacattgcagactgccgccagacagaaaacaattaaattaaataccctgagtgcacgatccacaaaagagcgttccacctcttttttactgttaataaataaatctgcttctttaagaattttctgaacccgttcctcgtctgtctccgctaccggaacctcagccgtcatattccggtattccgccctgcaccggccgcaggatgcaagatgggcctccacctccctgcagctctcttcactgcacagattttcaatataaagagggagcaaatcccgtataatttcacacttcataatgcaattcctcctttaattttttctgcagcatgtttttggcacggtaaaacaccactctggcccacacgtccgaattgccgtaacattcacctattttcttataatcatattccagaataatccgcagcaggaaaaccgtctggtacggctccggtaccgtccgcacctgttttatcacatcccttgccatatggctgcggattgtggcttcttctatattttcttttcccggcattttctccatgccgtcggaaccagccagcctgtcatcccggcgctgctggttgtaaaacaaattctttcctatctggcagagccatacgtccagtctgcagtcgcctctgaaggaatcgatgctctgatatgctctcataaatgtctcctgagccaaatcctccgccatatcatagtctccgcataatttcagcaggaaatagaagagctgttttgcatatttttgataaaccagttcaaattcgctgttgttcatatctcctccttttcctgtaagacagctctacggcagttttgttacagcttatcttaaaagtatctttattacttcggacaaacctttttctgcaatacgaaaggagaagaaacagtcttaaccgttcttctcccctgccagcacttcttttaataaagatatcatctgctccgcatcaacaggctttgccagatgggcattcattccgctttttccggcgagttcaatgtcttcactgaatgcatttgccgtcattgccacaatcggtatggtcagactgtctcgccggccggctccccggatctgcctgcatgcttcataaccatccatttccggcatccggatatccatcagtataatatcaaaaaatccgttttccctccttttatagatttcaaccgcctcctgtccgtttgaggctttctcactcttaatcccggccatttccagaaacgcggcggcaatctccgcattcagctcattatcttccgcaatgaggcaccgcttcccggccagactgtctaaaagctcctgagaccggaatacggagtcctccggctccttcgtcccgctttgaacctcctcctgggaagccaggggcagttccaattccactctgaaaacagtcccttccccctgtctgctctcaacttcaacggttcctcccatcagctccaccagtttttttgtaatggccattccaagtcctgttcctttatatctggatcttccataatcattttcctgggtaaaaggttcaaaaatatgcttctggaattcctccgacatcccaacccctgtgtcggatatcacgaaacggtaccggccggaatcttcgcgggtacagggcagttctataatctcaaacgttatccttccgccttccggggtgcattttaccgcattgctcagaatattcatgataatctggctgagccggaccgaatctccgacgactgcatcatggttcagattcgtctttttgaattccagtgtcagctgcttgttctccgcctgtctctccataatcatccggttggaatcgatcatggcccccatcgagaaagcttcccttgccaattctactttccgcgcttcaatctttgacatatcaagcacatcattgattattcccaagagcagcctggaagagatatctatcttcttcaggcagtcctccacccgttccccatcgccaatattttcccgcgcaatccgtgtcattcctataatggcgttcatcggcgtccttatgtcatgtgacatattggaaaggaacatgcttttagccctgttggcagcctcggcttcttcttttgcacggataatctcaagatattgtcccttatcacgtctgtaagtatataaattaaaataaatgagcgtgagcgctacaaggacaaggctcattccgcagttaacaagcacttttctcaggttgtcgctgaccgccgccttaatcacctccgccggcaccataaaaatctgatatccgtccatgcttttaaacggaagcacgctgatacagtattccaccttcccgtctttggcccatacggtagtgctttttccctgtattgcccgctctgttatattcgaaagcacgattccgtttgtaaatgacagttccccaaaataagtctccacactgtagaatgtctcaccgggtgacatatttccaacggtacgcataaatgcatgtccatacccgtcggccagtataatagttgccgccccgtcataaagctgttcattaagactttcgtacagggaggcattactgtatgccattgctacggccgctacctgcactcccgccacctcatatggctccacaggaatacctacaaaaacagcgtcctccgaactattaaaaaccccgaccctgaagacatcttccttctccttaaggagacggtccaagtcagaggaaggctgaatctttttccgccccccatcttttccggatatgtatccctcactgtctatcagatagatgccgaaaagatggttttccgccgcatttttgtccagataacgagaaagctgctctctgtccatctggttaaacatttttaaagtcccgctgatattgcggagcatgctcctgttatccgaaaaacgcatatcataaacagttatgttctgctgtgccactcttctgagattgctcgcgctcatgcttttcgtaatattattatatgcatagaaaagaagaattcccgttacaaaaatacagacaaccgatatgacggttcttaatatggcacggctgcctatgcctggcttatccacatctgtctccttcattctgaatcgtatcctgattttcatcctgcggtggacgcagaaacctttctgcacagtataatgctatgcgatcattataccatacttttacatgctgaaacagctgactttacaatataatgttataattaataactgaggccggaggacgcgtccggaacggatcatgtccggtgtggcgagggggggccctgtcgcggccactgcgtgtttccggcaggccggcccccgcacttaacgcgtgagacattcagcggccgcaggccagcggacggggccgatacccccggcggagtctttcgtctgaacgattgtttcagataaacagagaaaacatgcaataataccgcttttcttgacatttatgccaatttatgtaaaaatcagtgagaaggagagtgattaatatggattatttaacgatgactatcggaaaacaaaaaaatatagcattaattgcccatgataataaaaagaaggagctgattaactggtgcgaggagaacaaggagatcctgaaaaagcattttttatgcggaacaggaaccaccgccaggatgatcacagactatacaagtcttccggtaaagggctataacagcggccctctgggcggtgaccagcagattggagctaagattgtggagggacagattgattttatcatctttttttccgaccctcttaccgcacagccccatgatcccgacgtaaaggcgcttctcagaattgctcaggtatatgatatccccatagccaacaataaggcgacggctgatttcatgattacgtccagtcttatggatcaggaatatgaacacgacattatcaattttcatcagaatatcaaagacagagcacagactctgtaggctccggcgattaaccgccgttcctgtgacggaatcaaagccgtgtatttaaagactgtaccaaggaggaactaaccaatgaaacagcgcaatattgtggtgtgtattttactgctttttgtaacatgcggaatctatgggatttactggatgattgtactgaatgacgagacgaatgctctgtccggaagaataggcaccagcggagggacagtctttctgttctcactaatcacctgcggaatctactccctgttctggatgtatcagatgggaaatgctgtcgagatgctgcacgaacagcacggtgagcctaggggcagcgcgccggttgtttatctgcttctcagtctgtttggcttcagcatcgtagcctatgctcttttgcagtatgagctgaataagtatctgccggatgcgtaaccgttttaaaaagctttgtatcaggacaggctggctcgcaggagccggtctgttttatttattaatctgtaatttggcgggacgccccctgattccctgcatgtttcatcagataaccggtttatattgtcccggatgcggtgtaagccgcatgtgcctggcgctctttcgcctggactttgtatcggccttcagggccaatgccgccatctttctgctgctgccggccggactggcaattgccattcagacagccgtgcgctatgtaaagaccggaaacggccggctgacgcggtttcagacctggatcctggccggcatgaccgtcattctgctcctgttcggcatcctgcgcaatctgcccggttttacctggatgcagccaatgccatgaaacctacggctgatagttactgttcacaccatgccaaaagcggcgtgctgaaaacaataacacgcttcgcgatgcacagaaactgtataaaacgcagtttcgcgccgtgtaactcgggattttcgcgcagaaaacgcacgaaaacacctcgcgggacataaccatgtgaacagtaacggctgatatcattaaaaatcttaaaaaaataattgacaaatcattttaaacatagtatattttacaataacattttattagcttaaaccgatgaagcggagatcaaagtaattatgcgcgcacagagagtccgggatgctgagaaccagatcgaaatgcagattgccaaatggaccgccgagggcacagtcaaaagcagcgttgctgccgagtattctgtgacgtggggcatacgtcagttgccggagatatgttagtatctcgcaaagcgcatggatttgatccatgaatcaaggtggcaccgcgggtctgtgatacccgtccttgacagattctatttttctgtcaaggacgggtttttttaatttaacaggaaagttctcctgttaaattaaaaccgctccgcggtggatcgcactgcggcgggcgggattctttcttgttacatagtgagaagaagtccttcagaaaaataattatgagctataaggtatttattgatatttctttagaacaggaggcctgctatgtacccaacaatcgaagatttgaaaacaattgcagaaagcggcgtctaccgccgtatccccgttgcacgcgagatttactccgattgcttcaccccaatagaagtaatgagaacgctgagggcggccagccgccactgctatcttttggaaagcgcagaagataatcagaaatggggacgctattctttcctcggctgctccccttccctggaactgacctgcagaaacggtgttcttcgcatccgccgtggagatgaggacgagataaaagaggagaccatatccgaaacacttcatccgggggaggcgatacgccggatcctcgaggaatacaaaagtccgaagctggaaaatatgccgccttttaccggggggcttgtaggatatttctcctacgattacattaaatatgccgaaccggttctgggcaaaaaggatttggaaaacgatgatttctgcgatgtggatttaatgctgtttgaccgggttattgtctttgaccactataagcagaagctgattctgatagccggtgtggatgccgccgatccggagcgctcctacgcggaagtcgccgaaaagctggatgaaaccgagcgcctgctttacagttcggccaaagccgctttccgtcccctgaagctcaaggaagaactgactcccgcttttacgaaggaagagtattgcaggatggtagaaaaagccagacattatattcatgaaggcgatatcttccaggtcgttctctccgatccgctcaccgcggccgcagagggaagtctctttgacacttaccgggttctgcgcaccacaaacccatccccttatatgttctacttttccagcgacgatgtggaaatcgccggggcctccccggaaacgctggcaaagctgcagaaccaaacgctctataatttccctttggccggaacaaggccgcggggcagagatgcacaggaggatgaagctcttgagcgggagcttttgtcagatgaaaaagagctggcggaacacaacatgctggtggatctcggcagaaacgatttgggccgggtatgccgccttggcacggtaaaagttgataaatactgttccattgaacggttctcccacgttatgcacatcggctccactgtatcgggaacaatccgaaacgacagggacgccgtggatgcgattgattccatcctcccggccggaacgctctccggagcgcccaaactgcgggcctgtgagattatcggagaactggagggcagaaagagaggcatctacggaggcgccatcggctatctcgatttcaccggcaacatggacacctgcattgcaatccgcctcgcctataagaaaaacggccgagtatgtatccagtccggagccggtatcgtggccgacagcgttccggaacgtgaatttgaagaatgctgcaacaaggcaaaggcagtcgtcaatgccctgaaggcagcggaaggaggcctgttatgatattactgattgataattatgacagctttgtttacaacctgtaccaattgattggcagtatcacccctgatctgaaggtcatacgaaatgacgcctgcactgtggaagagatagaggccatgcacccggagtcgattgtcatctcgccagggccgggccggccggaggacgccgggaatattcttgaagtgatccgtcatttcacaggaaagacgcccatcctcggcgtatgtctcggccatcaggcaatctgcaaggccctcggaggcgttgtcacctacgccaaggaactgatgcacggaaaaacatccgaaatatacacagaagcagacagcaccctgttttgcggtttggaatccccggtccgggtggcccggtaccattctctggctgcctcggaagaggaactgcccggcacgctccgcattacagcccgtacgatggacggggaaataatggccgtggaacacagggagttcccggtctacggagtccagttccatccggaatcgattatgacaccccagggaaaactcatgattcaaaattttctgaacagttattgacttattgggttgttgaactatcgggttgttagacaatcgtgttattaaactatcaacttatcgaatcggcaggaaagatttccgaaggccgaaaccggcatatgaaaactggcagcagtatctaaaaatcggtatttaaataaatatatattttccaggaggttaatcattatgatccgcgaagcaattatcaaactttccaataaagagaacctgtcctatgaagaggcagagcaggttatgaatgaaatcatggagggccaggcaagccaggtacagatggcggcttatctgacggcactgtcaatcaaaggggaaaacatcgacgaaattaccgcatccgcagccggaatgcgcgcccactgtatcaagctgctccatgatatggatgtacttgagattgtcggcaccggcggagacggcgcaaactcctttaatatctccaccaccgcttccctggtcattgcggccggaggagtgccggtggcaaagcacggaaacagggcagcatcctccaaaagcggagccgccgatgtgctggaggcgctgggcgtaaaaattgacatcacgccggaacagagcgcggagcttctgaagaaaatcggaatctgctttctgtttgcccaaaattaccatatcgcgatgaagtatgtcgctccgatccgcaaagagctgagcatccggaccgtattcaacatcctcggaccgctttccaacccggcaggcgccaatatggagctgatgggcgtatatgagcaggccctcgtggaaccgctggcccaggttatggcaaagctgggcgtcacacgcggaatggtcgtatacgggcaggataagctcgatgagatttccatgagctctgccacctccgtctgcgaaatccgggacggatggttccagtcctacgaaatcaccccggaacagttcggatacgcccgctgcggcaaggaggagctgacgggcggaactccggaagaaaatgccgccatcacctgcgccatcttaagcggcgcggagagaggaccgaagcgctgcgccgtctgcctcaatgccggagccgccctgtatgtgaccggcagggccgaatccctggaggatggggtgcggatggccgaacagctgattgacaacggcagcgcacagaaaaaactggaagaatttatcagggaaagcaatcggtaagggagaacaaaatgaacgaaaatatccttgcagcaattgcagaaaaaacaaaagaacgaatcagggaagagcgcaggaagattcccctgttcgagatgagaaataacgccgaagcggtggcggcattcggtaccggcagacaaaaccgccccaccttttaccaggcgctggcaaagccgggaatgtcctttatctgcgaggtaaaaaaagcgtcaccttccaaaggcgtaatcgcagaagattttccataccttcagatagccggggaatacgaggcagccggggcagccgccatctcctgtctgacggaaccttattattttcaggggagcgaccggtacttaaagcagattgccagcaccgccgccattccggtgctgaaaaaagattttaccgtcgacgaatatatggtttaccaggccgctgccgccggagctgccgctatcctattaatctgcgcgattctggatgacgcgcagttaaaaagctatatggagcttgccgtctccctccgcctggatgtgctgaccgaggcgcacacagaggaagagatagaacgggccgtcagagcgggcgcctccattatcggcgtaaataaccgtgatttaaaaacattccgggtggacttaaacaccagcattgccatgcgttccctggttccgccggaaatcctctttgtctcagaaagcggtatccggactgcggctgatattgaaaagctctatgcaaacgggacgaacgccgttctgatcggagaggccctgatgcgttctcccgataaaaaagccatgctggatgaactgagaggaacgttccgatgacgagcataaagatttgcggcctgtcccgccccgccgacattgactggattaacgaagctcggcctgattactgcggatttatcatccacgtgccaaaaagtattcgcagcatcgatagcgggaagctgcatgaactccggttccggctggatgagtccatcactcctgtcggcgtttttgtaaatgaacctttggagtccgttatttcattgtccgcctgcaatgcattaggcgctgtacagcttcacggcggtgaggatgaaaactatataagatgtctgaagaaagaattgaccatacctgtcataaaagcctttcaagccgattcgccggaatccatccggcaggcggaaaaaagcccggccgacctgattcttctggacaacggagcgggcggaaccggaaccgtattcgactggtccctcctgcgccatatcaaaaggccgtacttcctggccggcggattagggcctcataatttgacggaggctataaagaccgtacatccctggggcgtggatatgagcagcggagtggaaacagacggggcaaaagacaaagaaaaaattctggcggcagtagccgcagtaaggagaacagaagcatgacaaacggaagatttggcattcacggaggccagtatatgcctgaaactctgatgaatgcagtaatcgaactggaagaagcatataaccattataaagatgatcccggattcaaccgggaactgaccgaactcctgaacaattatgcaggaaggccctcccgcctctattatgcaaaacggatgaccaaggatctgggcggagcaaaaatctatttaaagagagaggatttaaaccataccggcgcccacaaaatcaacaatgtgctggggcaggttctgctggcaaaaaaaatgggcaaaacacgtgttattgccgagacaggcgcaggacagcacggtgtagccacggccacggccgcggccctgatggacttggaatgcgaagtctacatgggcaaagaggacacggaacgccaggccctgaacgtctacagaatgcgtcttctcggagctaaggtccacgcggtcactaccggaaccgccactctgaaggacgccgtatccgagacaatgcgcgagtggaccagcaggattgcggatacccattatgtcctcggctcctgcatgggcccccaccccttcccaacgattgtccgcgatttccaggcggtcatctccaaagagattaaagaacagctcatggaactggaaggcaggctgcctgacgccgtcatggcctgtgtcggaggaggctccaacgccatcggaaccttctaccattttattgaggatgaatcagtccgcctgattggatgtgaagctgcgggacgcggcgttaacacggctgaaacagccgctaccatcgcaaccggcaggctgggtatcttccacggcatgaaatcatatttctgtcaggatgaatacggccagatcgcccctgtttattcgatttccgccggactggattacccgggcatcgggccggagcacgccttcctgcacgatcagggccgggcggaatatgttccggtaaccgacgatgaggcagtggatgcgtttgaatacctctcccgcctggagggaatcattccggccattgagagcgcccacgccgtggcacatgccaggaaaatagctcctgccatgggaaaagaccagattatcgctatcacactgtcaggccgcggagataaagactgcgctgccattgcccgttacagaggggaggatatccatgaataaagtatcaatcgctgaagcattttcagccggaaaagcatttatcccgtttatcacctgcggagatccgtcgttatctgtcacggaacagcttgtctatgccatggaggaagccggggctgatcttattgagcttggcattcccttttccgacccgacagcggaaggccccgtcatccagggagccaatgaacgcgccctctccggcggtgtgacaactgataaaatctttgagatggtgatacgcatccgggaaaaaacctccattcccctgttgtttatgacctatgccaatgtggtcttttcctatggaaaagaacgttttatccgcaatgccgccgaaatcggaatgaacggcctcatcctgcccgacgtgccatttgaagaaaaggaagagttcggctcagtctgcaaaacatacgggctggaactcgtttccctgattgcacccacctcccacgaccgcattacgtccattgccagggaggccggcggcttcgtgtactgcgtatcatccctgggcgtgacaggggtgcgctccaacatcacaaccgacgtgggggccatggtatcactcgtcaaacaggcaaaggatatcccctgcgccatcggttttggaatttccacgccggatcaggcaaaagcgatggccggaaaagccgacggagtgattgtcggaagtgccattgtcaaattatgtaaacaatatggggaggactgtatcccctatgtgaaggagtatgtcagagaaatgaaagaggccgtcaaagaggcggactgattggtaaagaggcgggttatccgccaaaacggccatgcaggctctattgtaagcctgcatggccgttttatctgtaactctgttttttctgctcccggctgaaaatattgaacagctttcggtgcccgcaggtgaaaacatgttactcttcgccgcagcagccgagattacgcatcgccggaacaaattttgccatcaacggaatataggtgataacaaacgctgcggccgccaatgcaagcagcccttttctccaccgcttcggagccgtaattccgatgataatgcctgcggcgcagaggcagattttgagaagcgccatatcctgccacttcatccctttaatatattcttctgccacatgaaataatttctccataaaaccgactccttccttcaaaaatacaccgttttcttatagtttcattgtaccatgaggatgtgcagatttccacataatattcaaatcattaaaggtaggaacagtaatataaaaatcccataccgtttttcaggtacaggattttcattaatcactatttactctaattattattaaagccagagcactttacaatacatctgaaaaatgcggccgcagctttttaaacatcttaagcccgatcagcataagtatcagcgtaaccgcccagaagtagagcgtcatcgtcgggcgttcaaagaaccagtttcccgtcatcatactgtccctgtagcctgccgcaatgtaataaaagggattgagcttaaacaccgttccaagccagggcgctctgtcggtaaagattttttcatcatacataatcggtgtcagccacatgccgaattgcaggcagattccaacgatctgggccatatccttaaaaaacacctgaaccgcgctggtaaaaaatgtgagcgccagcccaagcatggatgcggcaaaggaataatagagtatctgcagccaggtaatcatcggcatatatccgctgatcagataaagtcctatcatgattacaagaaagcagacgtgaaccataaagcaggatattaatttaataacaggcagcatctctacctcaaacaccacctttttgacaaggtaatggtattcctgaagacagttggtccccgtattcagcacctcactgaagaagaaccagggaataatacccggagtcagccaaatgacataggatactcccggaacaggcggtgcattcttcatgccatgctcaccaaaaataaacgcatatatcgcaattgtaaccatcggctggataaacatccagacaatgccgaaataggagcctacaaatctctttctgaaatctgctttggacagatccagaatcaattttcttttctttagaagccctttaacaagggtaatcagttctctcatcgaaaacctccggttaatttcagtaacagttcatgctgtctgaactgttattaattttaggagcgcggatttaaagctggaacttaaacgtatccttaaaaccgccccattttttatctttttcggaaataatcagttccatgccctcggtaaccggccactcgattccgatctccggatcgttgtaagccagcccgccttcatcgcccggatggtagaagtcggtacatttgtatgcaaactccgcctcatccgaaagtaccaggaagccgtgggcaaacccctccggaatatagaactgttttttattctccgctgaaatcacaacgccgaaccattttccgtatgtccgggaaccggtacgcagatccacagccacgtcgaaaacttcaccgcggactgctcggaccagcttgccctgaggaaattccttctggtaatgaagccccctgagcacaccttttacagacatcgactgattgtcctggacaaacaccatatcaaggcctgcttccctgaaatcattctgattataggtctctacaaaatagcctcgctcatctttaaatacggttggttcgataacataaagtccctctatatcacaaggggttactgtgatttttcccatgattactctccttttaatctgatctataagctgtctcacaatccataagccgggggcagcctgtacggtaccggctatgcaatactatatcactacctttggaacctggcaatagttgtttcagtcaacatgaacggctttatcagcgtgttactgtttacacccaatgatttaactgaggcccggaggacgcgtccggaacgtgtttccagcagactgatatcaaatcttccgcaatttttttaaagcccgttgaaggcatatcgtatttcccgtacacagtagcgctgagtgcccgcgacaaggtccgccctccgcacttaacgcgtgagacattcagcggccgcaggccagtggacggggccgatacacttggcggagtctttcgtcccggcgaaaacctgaccttgggggcggaggggaagataaagtctgcggatgccgcctaaatccatcgctgattagcgaggtcctgtcgagcttagcagcgcgatgcatttcacagagcgggagcgtgctccgcagactttatcttcgcccgcagccccaaaccacgacaatcttcccccgggacgaaagactcataaaaccaccccacccgtccgctggccgtaccggcggcgtcctcacctgcttaactaaatctaaaaacccacacatagcggcgcgctataaacaataacctattcagaaacatgttcggaaacaccagattcccgttctatccgcttttccttctcctcctgcgccctcctgttctcctccagagccatctcctgaaccagttcttttaccctggtttccagctgtgacatcttaattgacatatggaacatttttacaatcagcaggaaaatcaccgacaggaaaataaagttcgctgtcgtatatgtccccgccagccgggccagaatcgccggtaactgcggaaatatactgaacaaaatcagtataaaggaaaaaccaatccagaagatggaatcctctatctgaagtttggactggcggatccgcctcataataagaatcgtggtcgccacagaaacaacaattaaaacaatccgaagcataagcgtcatcatccgtcaccctctcttcctgaaattctgtatcagcaggattgatatcagcattttgatcatataccgggatgcattgaccggggtcaggtagctggctcccaacaggcgctcgtccataataacgggaacctccgcgattcttgccccctgtttaataagataggaaactgtatccggctccggtccgtaattcagtcctttggcgaactcctctatcatcctgctgctgaacattctcattccggaggtcggatccttgatatccacaccggttgtcatccggattgctttctcaatcaggttgctaccaagcatcctcatcgtaaatggtttcttctggccgacaaagcgggagccgattactatctcgtagccctcgtccattttttctttcatcgccgcaatatattccggcctgtgctgtccgtctccgtccagttgaaccgcataacggtatccataccgggccgcatacttaagccctgcctgaaaaccgcctgcaagtcccagattaaccggcagatccaaaagattatagccattgcgcctgcaaatagccgccgtctcatccctggaaccgtcgtttacaatcacgtagtcatactgcggaaactcttttatgagccggtttactacgcgttcaatattttctgcctcattataagcgggtattacaattagcagctctgccattttttcctccgtcaatgtaacgcttattattattcgcagctttgctggaaagcgcggttcttcgaacagtaaccaacaattattcccagtacgactggttcattgtaagctttttaatcagccggaccggaagttttttatatgcttttcccagccggtatccaatatatttaaatccgctttggagcacaagctccggaagcagataccatttcccattctttaacagccatccggccgttgtcctgacaagacgcatcccttccccttcggagggaagtctgccgaatacttccggatgatccgcctgggaaactgccagatcaaagttccggtgaagctgttccattgctttataattatgggaatgaatcacctccgcgtttgccgcataggctattttatatcccgcctttacggctgtggccgcgtaaatcatatcttcattaaatactgtcttcgccgtaaagcctcccagtttcagatagatgtcacgtttataagcggcgcagacattggaacagaaatacgtcttaatgccaagtatttctaagtcttccttcccctttacccggctgatacccggataattaaaatctctggtaaaacgctcaatcactccgcagtccgccgctggaagctgtctcgcataggatgccgcaatatcttccccggccatcagggccgaaaccagattttttaccagctccctgttatggggtatggcgtcctgggtcatacagatgcagatttcagcatccgattcaagaatccccctgtgtctggtacccccgtgatcaaaatcctcctgagccagatggattaaggtcagctctgtctcactgccctcaaacagcggctcgtaacgctctgcattccaatactggcgttccgtattcatgataatgatcctgtttggacgccaggtctgcttttgcagccgcttcagaagctgctccagcttgtcacccggcctgaaagcaggaatgatcacatctatttttattcttccgttttccggtacttctgccgaactcatctcgtcctcccggcgctttgccatcccgtacttattgtactaatttttagacctgtctcaactgttacagcattcggctaattgaaatcgcttcgcgatgagccgaatgcctgctgccactatcttttcgcacgttcagcgcagccagtgcgcagacctgtctcaactgttaccgtattcgtcataggccttcacgtaaaaatgcatcagaatcttcacaagccatccgggccacattttctcgaacatggccatctcgtcctttgtccgcctgttgtcttcaatgcaggctttcgtcgtcgccccctcatggaccctgtatgcaatcagcggtttttccacgcagataaatctgcccttttgtcctgcaagctcataaagattatcccaatccagagcaaaatcatacctggaacggaacatctcttcccccgccagctccttctgatacgtacaggccggacagcagagcgaattgccgaagataacgctgcttcgttttaccggccgcagacctgacagcaatttcagccggagcggcatccgaagtatcttcttcaccagccataccttgttgaagcactcggtcttcatccctctttccgtcatctttaacgtcatgtaatcactgacaaaaaccgacatgtcggggtatttcgcaaacgcctgataaagctcctttgtataatcgcttctgtaaacgtcgtcctgatgggcaatcgtcaccagacggccaccagctttatgccaggcaaacagccagtcctccctgatgttgctctctccctcccgcacatagagaggaaccgcatatttctttgtaattttttcgatgtaagggctcggagtggaggtacagcaaatcacatctgtctttacctgctgctccgtaagggagcggatgcaggcctccagataaggcgaatccttataggcacagactgcaaaggtatgcaacggctgtccttctttgtctgcgccggttataatgccggacctaagcaaacctcgtttctgtatcttcatcctgccacttcctttcaatttaaatgttacagacagaacttctgcagcacattcacataatactctgacaaaagaattcctcctgccagcgcaagcaccactgcgtagtaatcctgatttttaaggtgtacggtaatccatttcgggttaaacaccagccataccaggaacagaagcggaatgtagtaacgcccctgcacgccgtcaatataagtattgcccggtgttgtaaaaacaagatacatagatgtccagacaaggacaactgccgccgatgcgaggacgaatatccacaatttctgcttccagtcaagacgttttccacaggaagactgtccacccgtgaggataactgccgcagagcctgcataaatcagccagggaaacgctgcctctccctgatgtcccagcagtcccagcgatttttcgcccattacataagaaggcagggtattaaagatattttggagcaatatctttgcataagcgactggatgtccaagtatataggacatctgtcctgcctcgctggtattctcccccctcaaatctcctgtctcgctgggtgaaaagattgccggcagtgcaaaagaggccatcagtccaaggcacaaggctatcattccgcccttcatgataagacgctctttccggcttctgaaatgatccgcaggtattaacaggccaaccaggagcagcggcgcatataccgccttgattcggcatccccagaagaatgccagcatcatcacggcatagtccgtccaggttatctttttctccgtatctaaaatggcccggaggatgcaggcaaaggataaatacataaaagccgtcacagtcgggtcgtaggaatataccccggccagcatcatcggctccggcatcagcccgaggaaagccataatcccttttccgaccggtgttttcctgatggccagacagaggatgatacagtaaatataaaggttgcccagccttcccagcttatatacgagggagaagggcagacgaaacatctgtcccgctttcaggaataatgcctcgccggcatatccggtaaaaattgttttatttaaatcagcgctccaggtaattcccccgttccggtaatcgcccgcagtgtccagataattgtcaagctctctctgttcttccactgttcccggctgattataaggccaggtgtcaatcccggcaataaactcctgggtgacggcaggggaaaccgataccggcgttctgtagttggacagccagaagctctgtgaaaaatgaacctcctcatcccagctcaccttattggccggcagggacagggagaaaagcgtccctatggtgacggaaataaccaggaatcccacttcaatccgttttccaaaatactcccggaagaaaatcagcatggcggcaattccaagggcgcaccagaagaagcacagcctgtaccagttgacggcagggattgtgactgcctcaaaacctgagatttttaacggaaaaccggaaaaatcaatataagacagccccggctcgtcaagagcatcccggaaaatatagatttccgcatactccgccctctttcccacaggaatccaggaagtttttatattcttgctgtttctgtcttccaccgtcaggatgtcacgctcccgcagctcgccgtactcattataaactcccaccttcaccgtggcattcagcagcccctcatattcgtaggaataacataacttgtccacataacgtccgctaagcggcacgcgtatcttgccgccgttcccgtcaaataccagttttcctccgtcttcatggaatccctcataagtagtctgacttatgtcaactgaaaaactgccctggttattcccggagttcgcccggatcagcggaagattacagaatatttcgagaaaaatgcctgcaataagaacagccagcacggtcagagccagcttcttttggttttttataatttctttttgaacgttctctttcaaagtccacacctgcctgctctatttatcgggtaagctattacagttcagcctttggccaaactgcaataaacgatgcacagaaacgggaaaacacctcgcggaatacatcatgactgaattgttacggtatactatctcacgattttttccacgcctctgtgttccagaatccgctcgtaatcctcgatataatctacttccgcccaaaaatgtccgtccacgtcctccacatagaccggcatctcttttgtcagtccgtaaatcacattctcccaccagacggaatgctcctgccggttaatcatcgcttccatcctgccgcaaaattcgggaaggaacgctctggcaaaccggccgattccgatatattcacctgtaatatcgctgccctccagctctttcccgtatttttttaaaatcccgtcttcatagaaaaatttataatcggccgtctctttccggctctcatcggcaaacatcaccggactcttcttctccgccagaatccggtccagaagacggtcttccaggtaaacatccccattcataatcagcagatcgtctccttcgagaaaatccctggcaaaccaggcggaagcaatgctgttggttacatcgtagaacgggttatagaaaaatgaaacctcccggccctcaagaacgtcgcgtatcacctggctcttatatcccaaaacaatcccgatatcgcggattcccctggatttcagcagatccaccgtatactggatcagacattttccttccccgatatccaccgtacatttcgggtttccggaaagataacgcgatattctcgtccctcgtcctgccgctaaaatcagtgttttcacaaaagccccctgttctgcatgtctttcaatgcatcaatcagttttttattatcttctgccgtaagatgccctatatggcccacgcggaaaaccttctctgccagttcaccgccgcaggggcatacaaagatcccgtattcgtctttcagtatctcaaaaatccggtaagccgataccggacttccgtcgggaagcgttccggtgggatgaaggggcgtttccgccgcagacagcgattcggatacaatttcaaacggcataccggaaatctggcgccggaaatctgatgccaatgattctatctgctccctctccctttccattcccttttcgtctatcattttaagcctgcggttcatctggatcaggatgccgacagccggggtaaacggagtctgtccccgttccccgtctcttaaacagtccttcaggttaaaatagagcgacctgggttctgccttttccacccgtttaactgctctttcattcatcacaaccgcggcaatccccggaggcagggccaaagccttctgtgatccggtcagcaccagatccacgccccattcctccatcctgaagtcatcggccagaaaagagctgatggcatccaccacaagccacatcccgtttttcctgcagaaacggctgattaagtccatatcatagagaactccggtggaagtttcgtggacattgacgagaaaacccgtatatccctggcctgcatagggaattaaatgcccggccgttaatttccggccgctctccagttttatttcatcataaggaatcccatggacagcacagattttcacaaaacgcgcgccgaagctgccgccattcaccaccaaaagccggtcatccggggtaaaaaggttgattaccgccgcctccatggcccctgagccggaggctgtcagaaacactgttctggccttatcaccggccttcataaaacgggtcatcagggattcattttccttcatcagtgcggagaattccggcgtgcggaaatacggtatctcttctgcgccgatttcccgtatctcttcctccatctgaacgggtccaactgtaaaattaatcatttcgccattttcctcccatttcggttttctttcctgtaaaaatagagggccgtcagcccaaagcagactgtcagcgcaaacatcagcatcaggtaggacaacgctcctcccagaattcccatccacctcacaaacggagaggaaatcaggaaggcggcccctgccaccagggcatatatgacaaatatgtgcctgcgcttctgcataataatcagtgaataatagaacaggttaatataggcgttaaacgctcctcccaaaatgatcagaagcagcggcaggcggctgtctgcaatcgcatatcctaacttcggatacagcatgctcagcaccggtattcccaggaaccatgctccgcctaaagccagcaccgtaagtccggcaatgatggcagccagacggccgaccaccttcgcgaaattcgcaaattcgcggttttcccagactagggacagctttgtaatataaggcctgattacgaaaccggccaccaggttaataacgctggtcggcataaagatagctccgaaaatggcctgatctttgttcagcatatttccctcaattgcatatttggatgcggaaaatacatagaaatcaataatcgccgagagaaacagcaggaagttttcctgaaacagcagcgaacatctgcctttccggcagctccagtccacctggggaagctctccgattatggatatattaaatatcaggacgcccagaatctgtgcaatcaccgaaaccatacaggacagcaccaggttatggctcataacaaggcaggcgataaagctgcccgctgaaaagagcgtccggaaagtattggactttcctgtcagataaaggcggccgtctctctgaaactcggcttcgtatacatcggcaaagccgtctatcaccttataacaaaccattaaaatcaccgtcatggtctttacgtaagtataagtatcctggttaaagtatacatacagcaggccaaaaacaagcgctccgccgcaggttacaaaacgcaggcgcagatattccccaaaggtgtaacgccttcctatatccgtaatatgaaagggacgcattccgaaataggcgaccataaacatatgctgtccgaatgcggaaaaggcgaagctgaatattccaccttcgtcctctcccactacctgaatcaccacgatagacagaaccatcgatgcgaacgcatagagcaagcttcccagcatgttccagaccatattccgtttttccagattatcatctccgccaatcaggagtgttctgagtagattcatcacggttacctgtctttcatttgttgtcatatttttcacggcgacgtaccttataccccgggattctctccgccggaaaaggacagtttataaggataatgcgttttgcgtttttccgcaggaggaagctccatgaagtctccgtacatgttgatgagcatctcttctatattgccgggaaaattaatccttcttccctcaaattctatttttctgagaggatggtatttccgcttgtccaccagattccaataggggctggtgtcgggaaggaatgccatccggtccgtatctatcttctcataccgcctgcataccgcctcgcaccgccttctcaggccttccggcgaaatgcaaagcagtttcatgctgctgtaaaccaggccgcagaccgaccagatcagctttgccttccatcccttctgtgccagtgtgggtttcggaatggcccgcaggatcatgagcttgctgaaaaaccatgccgtccaggactgcacctgatacataaccgggttgtcggagacattgtccagcacatagagatccagaaaaattccgaacgggcagtcaacgtccttcatcacttcctcaataaatacggttccccgttttacaagccgggtcgtcatcagaggatatgccgggcatgtttttgcattcagaacaagatatttatcgcccatcttcttctgcacaatcttcagaaacttctcaaagtcttttctgggcatggcaatatcgatgtcatcatcccaggggataaaccccttatgtctgatggcaccgattcccgtcccggcaatgccgaaatattccagatggtacgtttcacagattagcagaaaatcatcaaggattgagaggatttcctgctgcaggcggcttaggatttccggttcgtagaacctgccctgtgcctgcggatgcggctcagcagcgggccggccggccggtatctgcccgtgggttacagttttattactgctcatctccaaattcctctttcgcacgtttcagcgcagattctattaccttatccatgtcatagtacttatactctgccaggcggccgccgaaaatcacattttcctcaccggctgcaagtccggcatatttgccgtaaagctcctggttcttctcatcgtttaccggataatacggctccatgcccatcttccagtcttcgggatattccctggtaatgacagtctttggctgtgttccgaattcaaaatgtttatgctcgatgattcgcgtaaacggagtttccctgtcggtataattgacgacagccactccctggtaattgtcggtatccaaaagctccgattcaaaccgcaggcttctgtactccagattgccgaagcggtaatcgtaatacgcatctatcattccggtgtaaacaatcttttctgctatcccgtcgtaatcttcccggttctccagatagtctgttccggtcctgatttcgcagccctcaaaaagcttttctataatagcattataaccatctttcgggattccctgataaggatcgttaaaataattgttatcataggtaaaacgcaccggcagacggcggataatgaaggcgggaagctccctgcaatcacgtccccactgcttttccgtatagccctttaccagttttttatagatatccgtaccgaccagcttgatcgcctgctcctccaggttctccggctctccgggaacggcttttttctgctcctctataatggctttcgcctcttccggcttggaaatgccccacattttactgaatgtgttcatgttgaacggcatattgtacatctcgccgttataatttgcgaccggactgttggtataacggttaaactccgtgaacccattgacaaaatcccatacttcccggttggaggtatggaagatatgggcgccgtactgatgtacccggatcccttccgtttcttcacagtaaatattgcctccaatatgctctctcttttctatcacaagacatctcttcccgtgttttccggccatccaggcaaatacggccgcatacaggccgcttcctaccagaagataatcatactttttcatccgttaagaattcctccattatgattgcaacaattacagcatcagacgccctttaacgggtgtctgccattgcattttaatatggtcggcacagtaagtgtgcaggcctgtctgaattgttacttacttgttactgtccgctaaaccgcgtttttcagcggggctgtgaatagtaacacttattttactatactttaagggaaaagtaaacaaaggcgttgtagcggcggcgcaaatcaggtatactctagataacagttcatgctgtccgaactttacttacacaattgtattcttataacgggtgtgacctcacccgcagcggaaagaggggaattttaaaatggatattttagacgatctgttaatgaaaatgattagctacaactccggcgatccgaaacggattcagcaccttatcaaggttcacagcttcgcgcgtctgattgggctgtcggagaatctggagagcgatacccagtttattctggaagccgccgcaattgtacacgatatcgggattaaacctgccgaagaaaagtatggctactgcaacggcaagctgcaggaacaggaaggacctgaacccgctgaaaaactgctccgttccctcggtttccgcgcctccgttgtcgaccgcgtctgctatctggtcggtcatcaccacacttattccgatgtggacggcctggattaccagatactgctggaggccgatttcctggtaaatctgtttgaagaaggactggaaccggaggctgccgatgcggcttatcataatatcttccggacagagacggggaaaaggatttgtgaggagatgtttttttaagtgagaagaattagtagtattggatatatattacggatttgtaatattgtgttttatccggcggcaatctgatttgaacagagtgccgccgggaaatatttccgggttctcattaccattttctttttcatcagcagttttgtataaaactgttttttcttattttcttaccataaattttatattcgtacgcagccacacctcctccttttgagctttcaatcttatatcgcttcatacctattccgataataatccatcaccctatattcaatgatatccttcatctgctccgcaaatccgctctgtttcactgcatcatgaagctgttcacttaatgcgagtaccgccccttccttctttataaaaaaaccattcccagactccatcaaaaaacgcaccggattcttcagtgcctcactaacccacctcttcttgtcccatgtcctaaaatctctggtggacttatctttttctaagtccttccagttattcgccgtataataaaatgtcatatcgctccgataaatatcttcttcatcaatttccatcttaatatcaccatcattataaaacgccataagaaccggcattttataggattttgtcatcttcgtagtctccatcatttccagtaactcattccctatactatgataaacagcctcctcttccgccccaagctccttcaaactatccagatatctcagatagtgcttaaacggactgtttttcacctcactgcatatctgataaacctcatcttccatataagtaaatagttccatcctgctgggcaccctgccatccagcagttctttaatgcggaaatattcctcgcggaccctatcgtctttttttgcccttttcttcgccatttcctgaaacaaatcaatcagacgcatatcaaagtctacaacacagtcatccggaaatgtaaaatctgactgctgcattcttccggcttccgcgctggaatacggtcttccgctgagcaaaaacggggctgagccggccttttcataattaccgataaaatctaggacatttaaaaaatccttccctctgctttttctcagtcctcttcctaattgctgcaaaaacactaccggtgattccgtaggacgtaaaaacatcaccatatcaatatcactgatatccaaaccttcattaaacatatctacggaaaaaataaccttgatctccccgtgttccagttttcgcagggccacacttctatcctctgaatacccgccatcagaattgctgtaaactgctgcagccggtatgtcacgcaggcaaaactcctttgccatctcctccgcatgttttctggaacaacagaaacccagagctttttgggaccgatacttcatgtagtgcttatagatcagagcatacctcttgtttaccaacagttccctggtcaattcttcctcatcatatttccctttcactttacgtatgccggaataatccaccgtctcgtcataaacgccataataatgaaacggtacaagcattcccttattcacggcgtcctgaaggcttatctgatagggtacattataatcacacaattcataaatacttcttccgtccattctctcaggtgtagcagtcagtccaagcagaaatttgggcttaaaatatgccataatccgcttatactgctccgtaaccgcatggtggaattcatcgattacaatataatcaaaataatcttcagcaaaatacctgtcatgtaaatacgcctgtcttcccaaagtagccacagacgcaaaaatgactgattttcccacggtcttctctttcccggtaaaaaaaccataatcttgagaatgccttacattctggaagcttttggctgcctgccgtaaaatctcttccctgtgagcaacaaacaataccttttcaaatcctgcggagtcaaatgcagcaagatatgtcttgccaactcccgtcgccgcatagaccagtcccttatccgccccttctctccggctgttcttcagggcataaagagcttctatctgcgctcccctgggctggaacagcatctgagcctcggtatcgcggctatctttgcttacgttatcatatctgtccaaatccttctgtaacgccggcttcttccattccttcgaatattgctttaatacctcatcatcaatgacaatcgaatggttataaaacaaatcttcaaagttctcaaaaaaacggttaaaattatccttatccctgaaaacgtcaaagtgataattccattctatccctgatgtaagggcgcttcgagatacattcgaggaacctatatagatttcaccgaattcctttttatgaaatatgtaagccttaggatggaaagaacgctctttctctttgtaaaaccgaaggtcaatctgatcacccaaggcatcttttatcaaatacaacgcccccggctgcgtaataccgagataatttcccgtcagaatccgaatcctggttccccgctccaaagccctctgcaaatcctttaacagcattctaaccccggattccataagaaaagacacaatgatgtcaattcgatctgcattcatcatgctatatttcaactgatacagcaaaaacctgtttttattttcgccgcctgtaatcgcttcacagcgttcatccttccacagcatagtctccctgttttctaactctttttccgtaaaattaagttcagccatttttcatcttctcttcccggacgcacatccgaagtaatccacatatcttctataaggaacaggcccacaatatccagcaatctttttattttatcctctgtcatatccgtaaagtaacggccgttccgttctgtttcttctgttccatacttgaaggacgtataaaccacgcctctagagacaagcgccgcagctatttttttaagcacatctgtcagctcacctctcgtaagatgtaaaatcgaggaacaggcccatattccatcatatatattgttctcatctagctcctgaaacagcatttgctttacctgaatccccgtgtattccgaggctatcttaacaagttctgccgagccgtccgtcgcttctgtctggaatcccctattaagaaaatacttcgtatcccttccggaaccacatccgaaatccaatattctggcgcctggctttagatattttataaatttttcctgtgtctccgtaaaaacaacattttgcgtattatccctaaatgcttctgcatttttattataatattctatggtttccgtcataaaaactgcacaattcctttcccagtaaaatatgttgcttttctaaattccaacatcatccgatgcaatttcccatatcttcatagcttaatttttgttctcatcaatattcagaatatagctgcacttaggaaaaatacataaaactcaccccagtgcttggacatttgcaggcatcacacctgctctgttcacattatatcacactatagctgtatcgtattagatatatcagtaaaaattttatcttactaacaccgtacaaaatggctgccccaaacggagcagccattatctacaaataaagcctttgccaatctttttgcagttttttatctttcattattcactgcctgtgacactgagcaaacgataacctgcacgctccgtgctgctcctgcagagcctatatatttgttaaaactgtctactttttaattatttttttgtttatctggtacaggaaaatccatattatgttctatttttcatttaattttcacatttttacttcagcaaagcggtttggataaatattcagtatgccgtcattggccagctgcttcatcgcatcacggatcggagttctgctgatcccgaactgagtggcaatcctggcctccggaattcgatctcccggcttgattttcatggataaaatcatatccagtaaataatgatataccatttcacttaagttgtttccctgatccgctttcatacaatctctttcagtatacattaagcaataaaattgtcaacaattcattataattaaatacagtttccctccgcaaccactccgatataatcatatttgttatggaaaccttcatatttcagcacgaaagaagtaataaaaaagtaaaaagcggcaaccggacatatggtaaaataacgataacctgcacgttccgcgcacatcagaaaggagaatctttttgaaacatattaacaaattatcaccatataaaattttaccggttctgctccccgtaatagcactggccggtgtgatgctcacggcctgcggccgtcagaaaagttcctcccctgacgccatgtcccccatggaaataagcgagatgcccctgtccgacagggaacgtgacctgatttcccttgtggacacccattcttccagccggattttcagatataaagcagatgataagctgaaaaagcttattttttctgttgaggaatttaaagatggcgaaatggtctgcctagcccggacaggcggacctgctccctccgagggcagtttatccgtcctgatggatccggacgagattactgtctcctgggatggcgggagatactcctgcctgattaattccacttcgggataccgatccagcatcaccagccatctcagcaccctctcctccttccactataatgagaaagaggttctggccatggtggcgaacactcagtcagataccatcacaagcggtaatgtgacggattaccataatcttcccgaccttgaaaagcgggggtatgaccgggttctcttcgtcaccgtcaccttctccgacactgataccccttcggaggatggttccgccgacagtttggaatatgacggcgggtcacaaaataacaataccaaagccccttctctgtcgaaacagacagacagtgaatttgagaacaggatactttttgcagacggggcaatctattacggcacctcggaaatcggccccatgggcgattcaggcagtgtggacgggtatatctcatcctctctggagcctgaagcaattccgggtgaggaaggacagtccaacttcggctgtataggcagcccatacacctgggactccggggacggcagaatcatggtactgtcagaggataaagaatggcatatcttccaacgacggaaagaagcaaagccctccggctcctattgcgcgtttatcaggcggatggacaacgataacctgtgggtggatatggcggagtggataacaccggaagacaaggaaaaagtccgctcccttaaactgacggaacacgatatgccggacggatattatatccataatcccagccggtcccggaccatactcaagctgacagccgacacacaataccgtttcatcgactgggggcgcagcttctccgactctgatgaaccggaaatgccgtttttcatcgaggtggaaaacggggctgtgacattgatcgaggaaaaaccgatcgcctgatgcatatcggttccttccgcagcgaaccagtcataagaaaggctccggagccaatgccggctttcatacggacggcggacaacgataacctgcacgctccgcgcacaggtcaccgtcatcaataaaagcctttcccggcgccgccctatgaggcggcacctggaaaaggctttttacactgctgtttacctgtttacaactcgcttaacttcccggagcgggattgaattttcaggcacgctgcgaactctttttatcccttatttataaaataatctgtttacagcgctgaatataccgcggatcgatgcccgcgtaatattggagctgattccgactccgtatgtcgcttctccggtttccacattcatcaggtgaatataggaagccgcctgcgcacccgaaccggagcggagtgcatgctcgtcgtaatccagaacacggatctgtatgccgagtgcatcttcgagtcctctttgaatggcatcaatcgggccgtttcctacgccgtcaacctcccgctcttcgccgtgatccgtgaagataagatgggcaaccgtggcaaatccgcctccctcgtactcccggtccgtaatctggcattttttgaaatgcattggttccttgcgatccagataattgatgcggaactcgtccataatctgttccggcgcaacctcgccctgtttctccgcaatcctctggataatatctgcaaattccttgtgcattccctttggaagacggaatccgtagaagctgtccatgacaaaggcaaccccgcccttgccggactggctgttgatgcgcactaccggctcgtattcccggccgatatcgctcggatcgatcggaaggtaaggcacttcccatatgccgtctgtcctctttgcaagagcctgcattcctttgttaatggcatcctgatgggaaccggagaatgcggtaaataccagctttcctgcataaggatgtctcggatccaccggcattttggtacagcgctcgcagatctccgtaatctccttgatattctcaatttccaatccgggatttatcccctgtgagaacatattgtatgcaatattcaaaatatcgacgttaccggtacgctctccgttgccgagcagcgttccctcgatacgttccgccccggccataagcgccagctctgccgctgcaatgccggttcccctgtcattgtgggggtgtacgctcaagataatgctgtcgcggtttttgaagtgcttattcatccactcaatctgatcggcatagacattcggtgttgtcatctcaaccgtagccggaagattgataatcatctttttctccggagtcggtccccattcatcctgtactgcggtacagatatcaagggcaaagtctaattccgttccggtaaaactttccggtgaatattccagaatcacttctccttcatggttgtccagatatttcttaaccagtttggttccttcaacggcaatttctttaatttcgtcacgctctttgtggaatacgacatccctttgaagtgtcgatgtggaattgtaaatatgtacaattgctttcttgattccctgaatggattcgaaggtacggcgtatcagatgctcacggcactgagtgagaacctgcactaccacgtcgtccggaatcagttttcgctcaactaattgtcttaaaaaatcaaattcaatctgggaggcagccggaaatcctatctcaatctccttaaatcccattctgacaagaagattaaacatctcaatcttctcctccaccaccatcggctcaatcagagcctggttgccgtcgcgcaaatccacgctgcaccatacgggagctttcttaatctctttattcggccattccctccgggggaaatcaactaccggtacacgcttatactttttataattcatcatctttcttctcctacaatacttacaaagtgatttttatctaatccagccaccgctcactccggcgttggaatcggtaaatcacaccacaaaatgcagcctgcaaacaattattaaaaattatatcattttgccttccggatatcaagtataaaccgctgccagtaaccagcagcaatactcaggccggcggtttctgttcctgcagcgcctgatgaattctgatatgatcaccgatcataagacacctggaatcgcttccgtgaccaatctgaaatgtttttgccacgggaagttccgggcggatcatccgaagcagttgttcttccaccgtaggatgcagtcctctgctttccattctagaaaacgttccgagcaaaatcccggatatctgacaaaataccccgctctggctcaactggtttaaatacgccacaatctgcggaacttctccgccattacattcaaggaacagaagtttcccggtaaaatcgggccagtactgtgttcctgccagtttcagcaggcagcggatgtttccgcccagcactgttccctccatcctggttcccctaagaaaatgaaaagagaagttgttcatcatacttccgccctccatcaatgtttccctgaattgggagaactactcctgccagcaggggcccgtcaggttgcgcagctggtacagccccgacttttttcccgtcttcgtataaatagcgttaatcaccgtcgtcaaatcactgtatccgaaaaatatcttatcggaggcgctgatcatttcgaaatccaaatcagtcagtacctcattagccatatctccgcccgaaacgtcaaaaacggcttttacggtctcatcccggtaaaaatccatcagcgcatgcgctctctgtgtcccggttccgctgaatgcggtaacgcctctgtacaggaaaggactttccaccgcctccagcccaatcagggccagcctttccttcagcagctccagagagcctttgtctgcctccaaaagtccgtttgaacagcaggacagtcccactctgtctccccggcggagaattccgccccccatatacaagttttcgcctggttccattatttttatcctccgattaccattctccaacattccctttccgatcgccctgctccatattgcttttcgcagccccgctgaaaaacgcggttctgcggacagtatctgtcaaaccactttatgagacatccatctcccgctcaaaaatctccaggtaaaaatgacggcgcggatggtccagtccgtaaacatgccaatccatacggccatcgggccaaagccaaactgcctgcacaggaaaatacagaggcttacccggaatgcccacattgtgacacaggaggtacacatggagaacttcacatcccccgccgcccttagtccgtaagccggtataaatgccagcgcccatacaaggggcttgacaaacgttatccaccctaccatataaaagcacatatctgcgctctctttctccattcctgccagtatcgtgatcggctttgtcagggcaaaaacagccagacagcttataataattacaatctcggccagtccgctcagttttttaatataataaaccgcctcctccttccggcctgctcccatgcactgcccgacgaccgtcatcaggccgatgccgataccgatagccgcgatgccgttcagattctccataatatttgtcatagcctgcgctgcaatcgcaatcgttcccattgtggataccgtagactggatcgccagctttccaaactggaacatggcattttcaattccattcggtatcccgacagccagaatcatcctgattttatataaatccggcctgattttgaaataatcccggatgacaagagtctggtctttttttctcaaaaaagcaaatacgatgacagcggaaaaaattcgagaacccagtgtagccaaagctgcaccggtgacacccattttaaatccccatattaaaacggcattgccgcaaatgttaagcccgttggaaaccacggcaattgtcatgggcagctttgtattcccctgtgcccggtaaaccgaagagcccgcatcatagagcgcaataaacggaaatgataatgttgtaaagaagaaatagatctgggccgcatccataacggccggctccacctgaccgaaaatcagcttcaaaagaggcatcctgaatgccagacaagccgcggtaaccgctgctgaaatgaccgtaacgacaaaaaccagctgatttgcggatcggcctgcatttttatggtctccctggccaatatactgtgagcagatgatggctcccccggccgccagcgcatagaatgcctggataaccagaatattgattgaatccaccagtgaaactgccgaaatggcggcaggccccacattacttaccatgatactgtccgctgttcccataagtgagttcaggatctgttccactaccagcggtatcagcagcttcctcagatccctgttgctgaacatgtgctttttttccatcttaacctctgttcccctgcatatgtcttttcctatatcatcatatgctttatctcttcatcatcccggtaatgtctgtccctcttgctgcaattggaagaattatatcaccggaaaaaggatttctcaatagcatgcataaattttacagtcaaactttcgaatattggtaataaaaacgaaaacgggcaaaaagatatcattttttttgacatctttttgccctaagcagtcttcaaaccgctgttatttaagtccgtttgcggcattcacgttgatgtttatgctaattctttttccttgccggcaataccgtccgcagccttatcattcccaaccagcttctggattccctggatggcaacaatcacgccgagaatcagcaggaggactgcaaacacaagctgaagcgtattgccaaagctcaggcctgttgtaaagaaggcgctgccgagtttgaatatcgtcattccaagtgcggtaaatgtcactgccatcataaataccataggaatccagagcatcgctccctgacggtttgtcttctttaagaatacggcgcaggccaccagagctaatacggataagagctggtttgccgaaccgaacagcggccatatctcagcgtatccgacctttgccagcagataggccagaatcagcgtcagggctgtggcaaaatatttattcgtcataagcttgataaatgagccggtttcctttccttccgtctcatcttccataaaaaactcctggaatgaaagacgtcccacacgggccacggagtcaagggaggtgagggcaaatgccgaaaccgcaagattaatcagggtaaacacgaggctgtacggaagtccggccgccgtcaggaagttggcaatcgccccggcgaaaatctgaggctgagtcgtaagtccggctgccgccgcttccccgtcggcaaaggatgccactgcgatcagcgcgataattgccagcatgctttccatcagcatggcgccgaaggacaccgggagcatatttttctcatttttaatctgcttggacgcggtaccggaggataccagagagtggaatcccgacaccgctccgcaggcaattgtaacaaaaaggattgggaacatatactgtccgtccacattaaatccgttaaaagaattcaggttacaggaaggattggagataaacacgcctgcaatcgctgcgactatcataaatacaagcagataactgtttaaataatcccttggctgtaacaggctccacactggcgctaccgaagcgatcagcacataaataaagataataatatgccaggttggccttgttatgtaaatcgggaagcagagaccgattcccacagccgccaccagcattccgattgcaatggcggtattgagccccttgcccagtctgccgtattttaaaatcattcccagtgccaccgcctcaatgataaacagcatggaggtcgtcgccaccgcgccgttggcctcaacagtggaggttacgccgtcggccgtcacaaaaccgttgaaggttcccgcgaccacgtcagcaaacgccgcgaccacgagaatacagaacagccagcaaaacagcagaaataatttcttgcccagcttgccgatgtattcctcaataatatagccgattgtacgtcccttattcttaactgacgcatacatcgcagcgaaatcctgaaccgctccaaagaagacgccgccgatcagaatccacagaagaaccggaagccagccgaacatggcggcctgaatcggaccgttgatcggacctgctcctgcgatggaagcaaactgatggccaaagacaacattcgtatcggccggaacgtaatccacaccgtcctccatctcaaaagccggtgtttttgctttggggtcaatcccccattttttttccagataacggccatacagtaaataggctccgcctaagactacaatggccagtaccatcattgtaataccattcatttgttttccctctttcttttttatctcttttcccatttgcataagtacttaccggccttatcgcgcattgcgctcctttgcagtacgatactccgcggagcgttttatatttaacaggaaaactttcctgataaatataaaaagtccctgcagcttacgctgcagagacgaaataattccgcggtaccaccctgccttgccatgtttatataaacacagcctcttttttgctgtctcaggccgtatggtctctttaacagcatcttttttaacggtaagaaaccgtctttccctataaacaccgcagatgttatatccgccagcggcatgttcaggaaagctgctcaggggtgagattgtcatggcgtccgtatcgccttccagcagccggcgactctctgaaacgggcaattccatccaacatttccccatccatgcattttcgtttaagactcgtacattactatgcgtttattgttttatcacttcatagctataaagtcaactgttttttacaaaattttaatattctgtttcatctcatgccgatgattatactacagtctttttactccatccatagccagcgccgagcgttcgcattcctctgcactcagcgtaatctgccagcagagagaactgcctttcatatattccgccgcatagctcagcccgttggttctctcgtcgagatagggccggtcaatctggttgggatcaccgagaagtataatctttgtgtccttccccgccctggtgatgattccttttacctgattcggcgtcatattctgggcttcatcgataatcagatacgttttcacaatggaacgccccctgatataattcagagcctccgtctggattagtcccctgtcaaatatctcctgtatcttatcactcaattccttctcattggaatagcgctgctcttcactggagtcaatgagctgttccagattatcaataatcggccgcatcagaggggaaattttctcctgctcatttcccggcaggaagccgatatccgtgtcaaactgggcgtttggacggctgatcagaatcctccggtattccccgttcggattattaacaagcttttcaagaccaaccgcgagagaataaaaggtcttgctggttcccgccattcccttgactatgacaagcggggccttatcggccggctgcatcagcgcctcctgcagaaaatactgtccggcattcctcggtgtgacaccgtaaggacggctcttcttaaaatccagttcccggatccgcccattctccactctccccagcatggtcttctttgtggactgatccgcctttaatataataaattcgttttcctccagtttgagacctgaatgctttccgttctcgtctgttatgtaaacttctttggtagaaattccttttttcttaaactccttaaacagctcctccggggcaaatacctccgtccttccgagatattgctccgctttgtcggatacctgttcggttgtgaaatcctctgctctgataccgataatctgggccttgatgcggagcaatatatcttttgttaccagaatcacctgggaggcttcttccgtctccccgcctgttatatgggccgccctgttcccgtcccggcagctttccgccagtcctttgcataccttcagaatcctgttgtcggctttttcatcgggaagatccctgggcagcttcacatcgacaaaatttttctcgatccggagcatcccgccgccgggaagcctgaccccttctaaaagatctcctgagactctgagctgttccagcagtctgatggcccgtctggcgttgttcccccgctccccctcagcttttttcaggttatccagctcttccagcactaccaccggaatcaccacctgattatcttcaaaacaattcagcgcatatggcgcctggatcagaacattcgtatccactacataggttttaatcattcacaggcctcctttaaggcaatttttattacctgctctatcatatgatcggcagacatgccgttacttctccgaacgctttcaggcgtttgtcttagggccgggatgaagcatgcagcatatcccctgctgctattataacggaacaatgtaaaatcccatgcaggctgcatcgtaaatatatgtaaaatttacattataattcagaagcggcagatgtccccccagaagccgctccgaaaaattacatttattgccttccggcctttcacgatgcatcagtcggaaaccattaatataatggggaagtagcctgtataacggcaatgcagggaagcaggcggaattcaggcccgatccgaatcctcacttacttccctgcttgttccatttctttattccttcccctccctgctatcctgttcttttgcgtctgctatgaccttcctttcgtgtctgtcatttcttctgttgtattttcctgctgtcttttcttctgctgattttttccgtccctctttccgcatctgtccttctttgcagttctccctatcagcttcccagataagctttctgaaccacatcgttttcccggagtacctttgcatcgtcctccagaatgatattgcccgtctcaataacatatccgcggttggcgatcttaagggctttattggcattctgctccacaacaagaaccgtgatgccggagtcattcaggtcttttataatcttgaagcaggtatttaccatgatgggcatcagtcccatcgatacctcgtcgatcagcagaagacgcggctccaggacaagcgcccttccgattgccagcatctgctgttcaccgccgctcattgtcctggccgactggttttttctctcctccagacggggaaacagttcataaacgcgtttgatactggcccttttcctcacattgtcctttaccttataacatccggtcagcaggttctcttccactgtcagattgccgaagacgcgccggccctcgggaacatatccgattcccatatcggcgcgtttccatgccgggagcgccgttatatccttatcttcgaaaaaaatgctgcctgatgcggctttcttaagccccatgatagtgcggatcagcgttgtctttccagccccgttcggtcctattacgctgattagctctccttctttcacctccaggctgattcccttgatcacctgcatttttccgtaattcacttccagattagagattttcagcatcgctttcgtcctcctctcccagatatgcttcaattacctgtggattcctccgtatttcttccggcactccctcggcaattttcttaccgtagctgagaacgacgatcctgtcgcacaccttcatcgtgatcggaaggttatgttcaatcaggatgatggttttccccttcgccttcagccccatgatcagctccgttacctcgttgatggcaaaattgctgagtcctgcgcacggttcatccagcatgatgagaaacgggtccgtagccagcgcgcgggcaatctccagccgccttaaatatccgaggctcacgtcccttgccagtttgaaccggtattccttcaaatccaccagttccatcagctcttccgccctctcaagcatctcctttgtatggctctttttaaaaaacgatttaacgcctgtatattcatgtatgccgagagcggccacgatattgtcctgtatactcaaatctcccagcggtttcgatatctggaaggttctggcaatccctttccttgcaatttcatacggcagctttccctggatctcttccccgttcagcagcacttttccgtccgtcggtttataaacgccgcagattgcgttaaacagcgttgttttccctgccccgttcggtccgatgattccaagcgtctccttatcgtaaaccgacatactgaaatcatcaatggctttcagaccgccgaattacatcttaagttcttccaccttcagcatctcatccattcatctcacctgccttatctttcggaaatagtttgtgcaggccccgcagaataaagctgtcacagccaagcagcccctgcggctggaaccgcatcatcagcaccaggattcctccatacagaatcatcctgtaatcagcggcgaaacgcagaacctcgggagccgcccccagaatcagcgctcccagcagcggtcctcttatcgtcccgattcctcctaccaccaccatggataagatactgatggaaacggtaaacgcaaagctgctggagaatatgaatgtcatacggtgcacatagatggcccccgtaagccctgcgatcgcggttcccagaataaacgccaggattttatactggcttacattgataccgaaggacatggctgcgccctcgtcatttctcaggctggccagagccagaccaaaccacgatttcgtcatcttgcgcgtcagcagacaggtcagcacgattaaaatcagaaggagcaccagaaagtgcatcggcgtcatctttgcgccgaaaaacgtaggaggtgttaccgacattcccagggatgccccgaagattttcatgttttgaaagagcgccaccatgacaaagttaataccgatcgtcgtaatggccagaaagtcatctcttaccctgaggctgattacaccgagcagccctcctgccgctgccgtgaccagcattgctgctggcagactcagccagaaactgattcctgcattcgtcatcagcgcagccgtatacgcaccgattccaaaaaaggcggcgtggcccatggccgactgtcccgcatatccggtaatgatattcaggctcagcgccagcagtgtaaaaatagctatatttaccgcaaccgtaataatataactcattccatcccctcctttacgagagttttttgctcactaagccggagggcttgataagcagtatcaacaccagtacaataaacgcaatcgaatctttcggtatgaaagaacctatgtacacagatatcagagtttccgacagcccgacaaaaagtcccgctatcacggtaccgaccgggtttccaagaccgcccaatacaataatggcaagcattttataggatggcgtctcgccgagagcaggtgtaatggagttatagagaattccgaccatgatacccgcggcagcggcaaaaccgtaaccgatgatatagctcaaggccgttgcagagttggtattgattcccaccgcccttgcaatctccggagcctctgccgtggctttccacgccagccccagcgtagttttgttaagaataaaccataaaataagaaacaggactgccgtaagaaccagaatcaggatccactccggggcaatgacaatattatttcccaggtgaacagcgccaaatcccagctctgcgttgtatgcttttgttcccgctccgcaaatcagtcttacaagatcaccggtcagtgtaaaaagaccgacgctggtgatcagcggaataataggcaggatatgcggcttcgccaggatcgggccgtacaggcatttgtggacaagcacgccgatagtacccgtcagccccatggacaatataaaagcaaggggcagatttcctgtcgtaatataaatgtagtatccgatataagctcccaccacataagctccggcattggctatatcaagaatcctcataattccatatatcagggtggcgcccatagccgtcagtgcatagacgcttccgataataattccgttgataatctgctgcaataacatagaattcaccgccttctatcttcaaagagatgccttaaataaggcatctcttctcccgtactggatacgactggttactttgtctcaggaacaatgatttctggatcatctattatatcgtaataatgatacttgccgtctttgataacctgaatctgaaccggctttacagcttctccgttttcggtgtaatataaaagttttcccgtaaccgtgtcaatatccttcagcgatgctattttatctttaatggcagccggctcggtagaacccgcttcttcaatcgctttaaagataacctggaatgcatcgtacgcggaagctccgaccatgtcaggctctttattatatgtagctctgtagtctttcataaatttctgtgtattctcgtcctttgtatcacggtccatgttggtcgtcagatagagtccgtccgcattctttcccgccgtctccaggaactgccaggaatccacgccctccgtgccgacaaccgggacatccagacctaatgtcttgcactgtttcataacttccgatgcatgtgcataataattagccatataaatcagatccggtttaacgtcctgttttaattttgtgatgatggaggtgaattcattatcgctcattgccactttatcataggaaacaatctctgcgccatgcgccttggcatactcctcaaaggttcccgcaagctctgaaccgtaatccagatcaacggcaatgatggaaatgcgttttgctcccagcttatcgacagccagaacagctcctgccttgccctgaacctggccggggaaggactgtgaaaagatataatctcctgcatttaccacgtcaggatgaacggcataagcagataccatcggaatgcccgccgcctgtataatcggagccgccacacgggtcggtccgctgtagcttccgctgacgattgcaacaacaccgtcctttgtcgtcagttttccgctatgctgaccgcctggttcgtgtcgagagcgtcatcataatccaccagctccacacttcttcccaagagcccgcccgcagcattgatatcagccactgcaagcttcgccgcatttaaggtactttctccgtccgcagatgcggaagccgacgtaagaggcgaaaagaatcctattttaatgggattactgctgtccgccgctgcctgcgcaccatctgaagattcgcctgaggcgggtgtctgagtttctgccggtttcgattcaggcgctgctgattctttaccgcccgagctgcatcccgtcagggaataaaccattgccacactcataacgactgatacaagttttttcattttcttcatagctgtaaacctcctttttatttcttatcatatggcatggccgacaccgggtagaaccttattttgttccgattcggaattcttctggttctggcagcaaaattcctacctaaaccggtaaaaagtgcgctttgcgggcttattaccgcaatcggcgatgagaaacgttttgtgtactattttcaccgccaaaaaacaaaaaaggccacacctgccgtcttacagcagatacgcctttgtgcctttttcattgccattgataaggttaggatgattgtagacccgtcccgtcgataaagtgtcgataaacgagaaaatcgttaagaatgtgtgattttgttaaggaaaaatcatgaccacccgtcaaacgggtggtttgctcgcccctataaagggacagtaccggccagcgcctaaagacgctggctttcactctgttcaagccactatgcccttgactcgtcgcctccctttaaagggcgtttgtaataccggctaccccttaaaggggtcctcatattcctttacactcagtttatccattgctatatcatacttctcctgttcctgaatgtacttcctaactgttgcctcatttagacctactgtactgacataataaccttctgcccagaagtgacgatttccgtatttatactttagatttgcgtgcttatcaaatatcatcagcgcactttttccctttaagtatcccataaagctggatatactgtatttcggtggaatacttaccagcatatgaatatgatctggcattaagtgaccctccagtatttccactcccttatatccgcataacgtttttaatatatctcgtatgctttctttatattgattataaatcatttttcgtctatacttaggagtgaacacaatgtggtatttgcacatccactttgtatgtgccatatcatgtttcttgtgtgccattaaaatcacctttcctttcttagatagtagcttgaacaactctattctatcggaaaggtgatttttgtggtataagcacttgctgcaccacccgcaaagcaggtggtttcctgtttcaggcattatcatttttcggaacacgaaaaactccaatgccttcaactggctaaagccagaatgaaagaacccctgaaaacattgcattttcaagggttctgataattttcttataaagtctcttattatctcttggataactccgaacgccgtaaatacgccatttttaagctgtttgtcagttacgtgttagttacccatatacgctcatatgtgctcatactgtccccaaaccatatattatgctatcttttccaccgccatcggtaattcatacagtgtgtccgggtcaatatccaggcacatcgtaacatcgcgattcttaccaatgtcccatgcaagagtatcattcattaccgtacaagtatctataaaaatattaatatcacgcagcgaacgaaatgcctctttctcaatcatcttggacatatcataagatacaattttcccatcttcaaaatatacataaacagagtaatctttcatgggtatcacttgcactaccttcggaaacatactgtcacctccttaaattaatggattaattctgttcatcggctttccgtctttggataattcccaattctgcatcaattcatcctgatgcaaaacacaccatgctaaaatcagctttaactgctttgatggcaaggcaccttttattactcttactccatctatttcaactattgctttatttccattgtactcagcatgaaaatgaggtggattatggtcatcataatacatcgtcaccctgattccatagaataatgatatttccggcattgtattttcctcctcacattataaaatatccttaacagtatatcttttacagtataagtataccacaattatgatctaaaaaaaaccggttctatactgaatgttggggtgtgctgaaaagcacacttccaacattcttttcgttgtaataaaatacatctataagaagcctcctaaacgcattatcccgaccaaagtttaatgttacggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgctccttcgcaaacgccgttacctctgcccatactgccgcaaacggttcacggaaccctattcgttcctccccagctaccaccgcaggacccgcaggctggcattttacattgtctccctgctccggcagaccttttccttaaaacagatcgcaaagcttaccggtgtttccgtccagacggtctgccgccttctggacacgatttgctatcctccgcctgaccagcttccacaagcgctttccattgacgaattcaaaggcaatgcttctaccggtaaatatcagtgcattctggttgatccgaaaaagcgccggatcctcgacattctcccggatcggacccaaagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcaattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggatctgcgtctggcacaccgcatgaaagagtggttctatgatatctgccagatggaagcgtatcgtcagcagcagagggaatttgatgactggattgcgaatgcacagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgccaaaatcagtaaaacctggaactaaacataaaaagggcccttttcattagaaggttctatactgaatgttggggtgtgctgaaaagcacacttccaacattcttttcgttgtaataaaatacatctataagaagcctcctaaacgcattatcccgaccaaagtttaatgttatggaggtgaccccttatagatgtaccctaattataccaaggctttccttaacttggaaggtgtttctattaaaaaagtggttcaggcagactctttcattaaaattttcatccagtcccaaccggtagaacagacttgtccctgctgtggggctaaaacaaaacggattcatgattaccgtttacaagaagtccaggacattcccttactgggaaaacaagtaatcctgcttcttcgcaaacgccgctacctctgcccatactgccgcaaacggttcacggaaccctattcgttcctccccagctaccaccgcaggacccgcaggctggcattttacattgtctccctgctccggcagaccttttccttaaaacagatcgcagagcttaccggtgtttccgtccagacggtctgccgccttctggacacgatttgctatcctccgcctgaccagcttccacaagcgctttccattgacgaattcaaaggcaatgcttctaccggtaaatatcagtgcattctgcttgatccgaaaaagcgccggatcctcgacattctcccagatcggacccagagccatctggctgattattggcggaacattcccaggaaagaacgcctgaaggtaaagttcttcgtctgcgatatgtggcgcccctacaccgaacttgcacaaaccttctttccaaacgctacaatcatcgtggataaatatcatttcatccggcaggtgacatgggcgattgaaaatgtacgcaaacggctgcagcgctccatgccggtttctctgcgtaagtattataaacgcagccggaaactcattctgacccgctacaaaaagctgaaggatgagaacaaacaggcctgtgatttaatgcttcactatagcgaggatctgcgtctggcacaccgcatgaaagagtggttctatgatatctgccagatggaagcgtatcgtcagcagcagagggaatttgatgactggattgcgaatgcacagagctgtgggatcaaggaatttgaggcctgtgctaagacctacagggcctggcgaaaagaaatcctgaatgcctttaaatacgggctgacaaatggtcccacagaaggatttaacaacaagataaaggtattaaaacggagcagctacggaatccggaatttcaaacggttccgaacccggatacttcactgtacatcataggataaaaaggtcggtaatgcggaggcttatttggcatgcccaaaatcagtaaaacctggaactaaacataaaaagggcccttttcatagaattggggcgggattttaacaaatcccaccccaactattgacaaagagccaaaaaacccgcaaacataatgtctgcaggtttttcacgtgtactataatatacaatttcttatcgtttgctgaactgtggagcacgacgagctgctttgagaccgtattgcgcgagtttttgagctgtttttccttgatattccgggcttttctgactttctgcttctcagttatccgatgtgcggaccataaaaaacggccttttttcattcagcgacaggctgatgaaacgcaccatttactaccccaaacaacttctctggtttattgtacttcacttttgcataaatgtccatagttgttttgctgttttcatgtccggcaaggtattgtactgtctttggatcaacgcccgcatagagaagattggtgatgtaagtgtgccgtagctgatggggtgtcacatcgaagtccagcgtatatttgattttgggttgattcttctgggtcatacccagcgttggagtaaccgtatatttgatactctccccatttacatacttataatagtttcggggcttggtggagcggacaactacatactgccacactctttgaaactgcgaagcagccagcggctctcctttgctgtcagcgattacataatctgatatggaattttctttcgcttctctcagacaatccaccaaacacttcggtatcggaatatccctttttgctgccggagtttttagcaccgtagaaatcacgggtctgttatgctctgtacgccaagcccgccttaccgatagataaggtgtatcctcgtccaaaaatacacaatcccattgcagtgcaagaatttcttcccggcgcagaccggaatacaaaccgagcataataaacaaatatggaggaagccccttgactgtatccagaagcacggctacctgctgatctgtcaatgcctccttcttttttgtcggttttccgcctttaccggatattcctgcacaggggttgtgttcaaggatttggtttcgctctgccgtataaaaaatgcacttgagcagcatattgaccttattgtataagccttctgatttctttgacaatggaacaagagccagccgaatatcgtcagcagtcacttcttccatatacatctctcccaggggtttgatgatatagtttgtcatatccctcgtataacctctgagcgtagacgcagacacctttgccgactgcatcagcagccacttctctccatactcggctactgtcgggtgctgccggtgaaagataatttcttccacctgcttccgggcctctaactgcttctcatacaattcttcacaagtagcggcatacaaactcaactctttgccatctgcatccgtaatcctggttctgtaatactggattcctttcaatgtaatggttccgtacttcgggatctgtgttttcttttttgccatctttgatcgtcctttcttgataatgtgtagtctccgtatctacactctctttttatcagaaagcctcgatttaatcaaagatacggctgatgtaaaacaaagagcgagacatccttgcctcgctcctgctttacttcctattttattattactgtgctgcgtcccagcttgcaaacgcgcagctcattgatctgaccagctcatccggcctgttatacttaacctttgcatagatgtccattgtaatcttgctgctttcatggcctgccaggtattgaaccgttttgggatctaccgacgcatgaataaggttggtgatgtaagtatgccgcaaccgatggggtgttacctcaaagtccaggctgtaaaccacttttccgttatgagcggccttttctcccaagacaggtgtgacagtatgctttactctttttccatcttcataccgataatagctccgttccttgaccgttctcgtaacaatatactgccacagccgcttaaactgcgtataggacaacggttcgccatcccgatttggaacaacatactccgaagtggaatttacctttgcttctctcaggcagtctgccaagcagatggggagaggaatgtttctctccgctgcctttgttttcaattcatccgaaatcaccggtctgttatgttcggtgtgccatgcccgccttaccgtcagatatggagtatccgtatccagatatactgaatcccattgcagagcaagaatttcttcccggcgcagacccgcatacaaaccgatcatgacaaagacataaggcggcaaatttcggatagcatccaaaaggcgctctgcctgttcatctgtcaaagcctgacgatcctcttgtggaacaccgccaccttttgttgtcagataaatcgttgggttatggtcaataatcctgctttccatcgctgcgcgaaagatagacttgtaaaggattaccacagatttataaaccgatgtagatttcttggaaactggaacaagggcaagctgaatatcatccaggctaacctcgcccatccgtttatctcccaattccgctataatatgtcgcctgacctttgaagtgtaatccgtcaaggtagtggctcgtacatgaaccgactgcatcagcagccacttttcacaatactctgcaactgtgggcgttttccgatgaaaagtagcattctcaatctgttccaacgcaagagtttctttgttatatagttcttcaggtgtttttgcgtagagagctacgagctttccattcgcatctttgattctggtcctataatataggacacctcttttcataactgtgccatattggggaagcattatttttctatttgccaattcctccacctcctaaaaaagatctccagcgctgtacctttgttttatcaaacatctctgattccatcaaggatacggaccggctcacgatcttccgcttcgaggcttacggtaggttgtgcttctctcaacaggctttgccctgtgcgtacattttgcgatatactcctggagacccgccgcagtaaaatacacacagccattctgaacatactgcacataagagatcaagccgttgttacgggcggcatccagcgttgctatgctgattcctaagatttcagcagcttcttttcgtgtaatgagtttttccatagaccatattccctccaatctatcaaggttaccatcgtgctttcaaaatcacatgaatacgctggcagccgaaactgccagcgcatggtatctgattttgaatagaaaacgaccacctaagaaagtaatcgcttcctattttaatgtaactcaattctcgccacatttgccacgcaaccctgacgatgggaacatagcaggtctccgctggcgcagttgtcataactccgcagcgtcgttttactcgtgcgccgcagggttccccccaagtctttaggaggccgtgaggaagtatctttaagcccccgtgcagtcctcgcgccggatctgccaccatccgttttgtgaaatcgtagatcgctccgaagcagctctgctcatcacctccctggctgctccatcttcgcggcgttccacactcgctcgtacacgggttatgtacctgttatgctgtctatgtaattgtcaaagtgctgttgaagggggaaaacttgtccttcttattaactctgacaaaaagagcaaaaaacaggcgcttcaaacgaaattttatcaaaatatttttgttataagatgcaaaacaagaacttatccagttttatctccactctgattagtagtacaatctaagaaagaacgaaaatagtttttagctaaatttattcataatttgtttgcaatcaaattcctagccatacagcagaaaaatgatgacgaaagatcatgcaaatgctataatgtttgcatatagatatgacaatttgaccatatcggaatctttattcaaacagatgattggagatattgctattatgagaaatccatggccaattttcagcattgcggctctctctggagctgcatgtctgatttatgatcactttttttcttacgagactatgtggattgctgttgtagtgtttcttgcgctgcttgctctatgctttttcgcatattgcaaatatgaacattggctggcaaagaaacttaacccctatgtggtggcgtatcaaagcaaccataatcttgataatttgaaacagggattggatcgctggcgtccctgggcactcagcaagcattctaaaaacatcattacagcaaactggttctccgctctgctggaacaacagcgctggacagaagcggaagaaactttggagcagtttttgcatcgagcaaaaaatacgcaggataaactggggtatcacctacttcgtgaagattacgcaagggcgatcggagacactgaattagagaagcaggaacgacttctaagcgaacagctaaaaacccagcttgaaaataaaaagggagaatcaagaatacccgcaagcgccaaagagagtaaatatgctttcttttgctggctctctttcagcgttggtctggcactgttcggaatcatcagcaatatcgccaccggggactcaatccttggatcgtttggagccggagtttttattttgggcttgttctcgttcccagtctgcttgatctggctgattctctggttgatccggcgcagaaaggaggctgctaaatgacttatatcctcccggtactctatgtaattgtgtcttatacattctttcttttggcagttcattttggcaatgcaatcacattgcagatagtatcgatccttctgccctttattatggggatcgtcaatttgattgttgtgctgaccgtaggaagaaagtggtcgagaaaaacattgctgaactgcactttgattatcaagtatggactgatcccgttctacctgatcggagggagcatcactgtatatgtaacgctgatggtattcttcccattgccgctgatggcgttgttcggactggtaaccattgtttttttgattttgggatacgggattctattaggggcagctccctatgctatcgcttatctgataaagtcatgcaaagacggcatacatccgaaatggttggcggttttagctggaatctgccagttcttcttttcctttgatgtacttgcaatgatggttctgacattaaaggagcggcacagggtcaaaacgacgattgccgttttctgtgcaatgtgtcttgcgctcctgcttatcgtactctatgtggtcatgacgctgataggggcataatcgacctttatataggatatgagttgttcatacataaaacaaatttgatagaatcgcagaaaggatttacgcttatgaaaaaacaatggattgctttactgacaggatgtgtgctggtatgcagtatgctggccggatgcggctcaaaacctcagacatcagctccggcagctgcgggcagcgataaaggctgtacggatgaggccattctgtctcagctgaaaaatgacgggacacctgagttcgtactggatggcacttactacacacttcctttggaaacttcccagctgatacaagccggctggagtttggaaacggaagaatatgatgcagcagaggtttctctgcaacccggcgagcgtatttatggggaactttccaaagacgatcaggaaatagatgttgcaatcgtaaatgccgggacagagccatgcaagcctgctgagggcggaacggtggtagaactggaatactctgccgataaggatcaaccaaatcctgatttctttgtaacgctcaatgggatcaactgtgcgatgtccaacgcagctttacaaaaggcgctggaaggtgtagacggatataaactgaattccgcaggaaatatcgacatcaatcgtactgttgatgatgatgaaattgctgtttataaagtcattctggatgatgactacacagcaatcacgcttgcttcggacaatgtttttgaatacaaggattatcagccgcaagaggtaaaagaacaggcatctaatgaaaagattgccgcttacaaggatactacaaaagccgagatggagccgtatgctcaggatttcaatgcgatcatcgagggatatgaagaaaatatggtcgttggattttacagtgaaggtactatttggggcgaagaagtcggtgaatataaatctattgccggaacgccgctcgcttcggatgtgtctctctacatcgcagaggatacaaccggccagctctactgtattgctaaccagattttgaatgaagatggtactgtaagcactgccattgagcttgaggaaggcgatcaggtcaaggtttggggttatgcttcacagtatctggaattgcaggaaggtctgaaaatcgtcgtggttcagcctggtatcattgaacgcaacggcgaactggtgatcctggacaaaaatttgaaagcagactaatgcttttgaacgccgggtgcatctatcaaaggattgcatccggcgttctcaacttaaaacaataattaggaggaacaattatgcttacaatgaatgaaaaagataaaaatgaaatgttggaagccattttgaacgaaaacgaagcctaccagtgcaagttatgggcggtcatcatggccggggctgatacctatgcactgattggaggactttctacactgacggggggcgctgccgctgcattgggcgcactgagcaatgcttactgctatctgggagttaccgagcaacacctgaatatggtcattgtaaattccgtcaatgtctccaaaattgaaaaccggctttctctgcccctaagcagcataacaaaggcagaagtcaagggtgggctgctgcccggaagaaaagtcgtaatgctgcatttcggaaaagaaaaaatgaaaatttctttgatgaacaatgcgattggctctgatattcaggggcagaaagaaaatgttgagatgttctgccagattgtttccaaactcggataacccgtattataaagcgagaggaatcagagcatgaaaaaaattttaattgtgttattagctatggtgctgctccttgctggatgcggtaaaaatgggacttcatcgccacaatctccctctgatgaatctgtgacggatcagcaggaaccttcttcttctgaaaccgaaatatcatctgaagatcacgcgattcccggaacttataccgtcccggagggatgggagaaatctgagaagcattctactgattcgcagattttctacatagaggaaggtcacgaaaatgatgaaaagccggacaacatatccatccatgtaggaaagaacaaatatagtctggaggagcatgagcagttccgggatgcgatcgtccaacagattttgatgcagctggatggtattgaagcacaactgaacggggatggaacctataccgagcagggagatctactgtatatctttactatcgacgagggcgatattgtcaccacgcaatactatattgtaaaggattacgggttctgcctgatccagcttacaaatttcagcggatcagaaaccaccgaacaggccgccagagacatggtagatagctttgtttgggatacagaaggataaattgacacaggaacagtgattttataggaaaacgacgaagatggagaaacaaaaactttcaggaaaaacaattttgaagctggcaggggcacttttagctttggcttatttgggattttgcctctatgcaggtattaccgggaaatttccgaatatgcacaaagccgagcatgtgatgcgtttcggtgaccttaaaaactgggtgtccggcggaatatcggctgtgatgatttttgccctgtgcattacttctgctttcaatgacctaaatctccagaagggacgcaaaaaatcatttttgccactttttctcaccatgattctgcccattatccttttactgcttttggagtcttatctggatattggttggatcgggattgccctttatgccggtattgcagtttttctatttggcgttgcatggactccacaactgttgaatcagtggatcgcccgccgacttttacgaaatgaaccgatgagcggcaagcaacaagtgcggatcattgagtggattcattttcatccactgaaaaagttgctggttttcgggctgtggggctttggcgttgtactggttctgcgtggcatctgggtaacggcaaccgggaaaatcgaaatggatggagagctttttctgtttttacttggcacagcagttctggttgtagcgctgtttcagaaaatgagacgctatatctgcacgccttaccggaacataccggtactgaatcagattctcagcaaaaatcagctggaacagctgctggatggagaacattttgaaccaatagagtttgaagatgagggcatgaaaaagtatctggaaatataccaaagccagaactggatgctgattggcggtaagctactctcaaaaaagctggctttatggttcacaatgaatcggttcaggaaccatacttccctgaaggtactttacctgaacggcatgactgccaaagcaaaggtcgatctggatattcgaggggaccggtacacggagtttactgctgtgctgaaagaattgattggatacgaaggcacacttaaactgtatgaaaaagaagaacagctggcacagaaatttgcatcctttttcccagagcaaacttccgaacaggaccgtgtcgctgcttttctttctcaggatgtgacagcgatccggcaggactatattcagaccttctctccaccgccagatccccgaaagaaaaaacggagtagacgggaacgggaataaaaggttttcttcaatttcaatggagaaaggcttacgaaaataaagaggatataacttgggggttacctatgaactatgatatgaatatgattaaataccgcaaaaatggtttttttagaattgcagcagctattctgattatctgttttacactattggggcttaccgcttgcgccggtactactgacagcaaagataataacgatgataatgcactgatacaaggaacacgggaaatagataccggctctggttctggttataaattcgttgacgataagtttatgtggttaaaatccatcgagaatgttaacgataactactggtacggagatgttgagtattataaaggtgctgaagcaatggatatagcaggactaacagaggaggaacttaagagcagcctgccaggtcttaaacctgaaaacatttttgtaacaaaattagatcccgaaaaaatcattaccgatggtgaggataaaactgctaccaatatgaacgaccaaaccttatggactcgcttatggcttattgaagaaaatgaggacagtgttgctgcggtagtgtttgatttagaaacttttagtatggagagctacactaaagttgagtaaaaaccagaaattagaatttggagtaaacttatggactatataatacgagaaatgagaagcgaagaatactgtttattaagtgattttttatacgaagcgatttatattccggaaggtattgaacctccacctaaatcagtaatagaatgtccggaattacaagaatatatcgtcgagtttggaaatcgaaaacatgataaagccttagttgcagagattcagggaaatgtagtaggagctatttgggtaagaattatgaatgactatggacacattgataatgatactccatctcttgccatgtctgtctgcccccaatatagagggttaggcattggaacttcattattgaaacaattattacaagtggaaagattagctggatattcaaaaatatccttatctgttcagaaaagtaattatgcagtgaagatgtacgagaaagtgggatttactgttgttaatgaaaatagcgaggaatttattatgattgtaaatctataacagaaattccagtttgcataactggcaacccaaccacaattaaatattcacagctctactaagcaggagatccgaaaaggtctcctgcttttttgcacccacagccaactctgtaaaatacttatctaaagatggtgcaatagaaaggggcgcaaggctctgtgccggaagcactttgagaccttgcgccctttgttattctatcctaaaaatactttgccagcttctaataatacatcctccattccgatcccttttctcaaatatcacatttattgggtggaatattaaaacttttccaaaaggttttctttcagacattcctgttcatgcaaaataccttggtttattaccagcacaacatctgcttcttcagcaagctgtttgctatgcgttactacaataacacactttcccaactcatgagcagttttctttatcagttcaataatttctctggccgtatcttcatccaaattgccagtcggttcatccgccaaaagcaccttggcttcacttgctaaggcacgggcaatcgctacacgctgctgctgtcctccggaaagctgtaatacattcctcttccaatcctcacggggaatgcttactttctgtaataaatcttcagcattctttgttccacccagttttacattttcttctgtggtaaggtaatcgatcagattgtaattctgaaataccagagatacattgtgtctacgatggtaattcaaaccctttttgcggatgtcctcaccgctatagagaatacttcctgataccggattgtccaatcctgctaaaagtgataaaaatgtggtttttcctgaaccactggaaccaacaatcgcataaaatgtggattcttcaaaagttgcagacacattatttagaacatttttatcgcgttttgatttataggaatacaagatattttttgcttctaaaatcatttccatccctcctagctcatttcacttaaaatatcttttggctttttacggaaaatcaaaacactggcagcgcaggtagagaaaagaatcaatagacctacactgaggctatctatgagcaacatattggtcgtgatttccgtttccacattcataacagtaagttccggcggccgataatcggtagatacttttcctgcattcatttcatcctgtaattcggcctgttctacctgctgacctaccagataatcagcagctgcatcggaaactgccggagcgatcaagaaggaaagtgaaagagccaaaacaccaatcaaaatcgcttctgttaaaatctgcatgaatatctttcccttggcaattccaagtgatagcagaataccaatctcattcgttctgttcttgatccaaaaaataaaaatcaggaataagataacaaaactagctcctgtaactatcagaagcaatgtattgctgatattttccaaatcattaaaatttgcagccattgtatcaagattgccattgttatcaatcaaatcataccattgccagttaatattcgttttcttgatggcttcttttacggcatcataatcatcaacattcccaaccttaaaataagccttttcatacaacgggtcatcctgctccactttttcagggaaatgtagatctgtaaagataacattttcagagcggaatgtatccccagacatataaggtttcattcgttcctttacctggtagataccaacaatagttgcttcctgcacaggctcttcatttttcactgaatggaattgtagatgatctcctacttttaactgatttctgtttgccagttcttcagaaataacacaggcatttaaatcatcttttgttgtcattcggccttgtgtgacggaaacattaccagaaaggacattggcatccaacatcatgtctcggttaccaattaaagttaccccctgaaaatcattagtttgatctgtatcggcatcttcaattctttcaaagtttttatgctttactgccgttggaactgttgtgatattatagtcagcaattccctctacgcctgcgattttttcaatatcatcctgtttcaatgattcaaaagaattatctgtcaatactccccagttttctgctcccatagctgtatattttatttgatgaaccccaccatagcttccttgtccatctggatagagttctgatattttttggcaggcttcatctactcgttgacttctactctccggattatattccagaagaaatcctgcgccgattgcctgacgcgtactgtcttttgttgcgatgtttgcagatctgcttgccattcctgaaagaaaaagcagactgataatacagactacaagtaaaagcaacagacttttgaccggttttctgaaacaggatctggttgctcgttgaaacaaattcatcgtattatccctccattcgtgataaaatgtcttttggatttgcacggattacaggcaacagcgacagtaaaacagcaatcaccacaactccactgccaatgcctaataacaatgctacatccgtaagttgtaaagaaacttccaaagaagcgccggtttccacagaggagaacaacaggttctgtaaccaacttgctgtcagagttccaaatccacaagcaaaaaccagagcaataagaaatacgatagctgcttccaaaagagcctgtaaaagaataatgtgcttctgttcacccatactgatcagcacagccatttccttttgtctgcttcgcatccacatacaaagcagtaaagacacaatcattgtaccggtaaaaaaggtcagtaggcgcatcagtgctacaactcttgttatttgtgttaaaggagctttcatctgctgatacagcgcatccgatgtggtaatatctgctttctcctgtaaaatctcctgtatgcttcctgccaatgtgtctaaaagtttcggttgtccagtataagccaatactttataaaatccacagttatcaaataagttcacataagttgtattatcaatataaatctgattttccatccggtagacagcagcggttgttttttcctgttggctttcgttcccagtaaggtattccccaatgactgtaaccgcaactttttttccgctttctatttccaaagaaaatgtgtctccaattttcagaccattggcctgagcaaattgggcattgattactgcgcttccttgtgtttccggtttaatccattcgccgtccgttaaatggtaggatttatctgcaaaaggactgtctctatccatatcatcaaaagataacagattgactttcagattattcgactccgtggaagtacttgcactaactggtacaagatctgttaaatatgcggcttgctgccccattcgattgattgaagtgacagcttccaagtttttaatcgtttcagcttctgtatctgtaataggatgagtcgtgttcataatttcacataccacctttgctcccgctttttcctgcatggcagcttctgtcctttcggtggcgtgtaaaatcatgttggtactaagaatcatgctgttgacaaacagaaaaatcagtagcaacaataccgactttgcccgtttccttgccagatacagaaaaccccttttataaaaaggcatcttttaatccccccttacttatatcggggaagcagtattttggtagcatggatggttccatcatcctgtgtttctccatagatataaacggatgtagattttttcacatcagaagctgtggctgcttcaaattctacagctccagtagcactgttaatgtttgcaatatgaaaagtacaatcttctccataagaaacagttgtactctccagagtactttccatgccatttgctgccaactttgtcgtctgggaatctacttccattggaataacctgaaaacttccatcctgaaattcagctacgcttccacccaaaatggcttccgcctctatatcgtctaaatttccaggtaattcttcttttcctttttcagcatctgcgtccttatttccacctggcatctcgccttgactgtaggcaggtgactcactttgggtttcctgcccggtttgtgtactgccacaagctgccattgagagcgtgcagaacaatgctaatgttacacctactaatttgatttttttcatttgatgtatctcctttctgtttgtgcggatttatcatacaacagaattactctaaaaatcctctaagaagaaataagatttttcctcatttttggaggacttttagaggatttctctgctatactaaacacaaaaactatattcaaggaaaaggaaaacaaagaataataaaaatactactcatggaagatgatcttgacttgtgccaatccattcaacaagcactgaaaaaagaaggatattccgttgactgctgcaatgatggagaaagttctatgatatatgcattaaatactgactatggctatgatcttgccatcgtagatcgtatgcttcctatcattgatggactgaccatcataaaagctatgcgcagaaaacaaattcaaattcctgtaattatcattacgggaatgtctgctttagatgaccgagtggacgggctggacagtggggcagacgattatcttataaagccctttcacattcgtgaactgatggcaagagtgcgagccttgacacggcggccacagcaaattcaggaaatgggaatgctttcttatgcagatcttcattttgactatccaaatcgaaaagtcacttgtaacggacaggagcttatattgacagccaaagaaacagagcttttaagtgtgctaatgaaacagccagaaacatcattttcaagggagcagcttgtcttaaaagtatggggcagcaatgccgacatagagccagggaatgtagataactatatttcattccttagaaaacgattaagagagcttcatagcaaatgtgcaattacaacgatttatggttcgggatatagattggagtctgctcatgcttaagcgcttacaaaacaatctgcgtatttttctgattatgatttttatggttgttatctctctcatcctctgttttttcttttggactacatggcaggatcagcagattgcggatattgcttatattcagcgaatggcctccttgcttatttatcaattagaagctgatccagaaagtccggacgagctgctttctaattacgagcaagaaatgaatgtttacagcattttgaaagacaaagagggacatatcctgtttcaaagtaaaccggacacacgcacagatctggatacactaataagaattgcagaaaaaagcattgaaatacaatatcccgaagagcaaacaactatttcttcaatcacagcacagggaggatacggaaaaatcactggaaatgatcacgatagctattatgtgattccgtccaacattcacacaaaagcaggaaatatctattcattagttttgttttacgaaccatcctccataagctctctgctgcttcaacagttaccagcatacgcaactatctggcttttggcttttatattgattcttttagcaagccgttttttattgcatcgagcatttgaaccaacagaacaggtattacaaagtcataaagactttattgcggctgcttcgcacgaattgaaatcaccccttgcagtaattatggcaaacatagaaagcattcagaatagcgaaataaaagaaccgcagacgcaaaacagtctaaaagtgattgatgcagaatgtatcagaatgtcacgactggtacgagatatgcttcttctggcatcttcagatgcagataagtggaccattcatacacaggaggttaatatcgacactctgcttatcatgttatacgaagcgtatgagccgatatgcagaaaaaaatcaattcacttagatttgaatttagatgtagaaagctacccacaaatctacacagaccaagaacgcgtttttcaagtattaagtatatttttagataatgcagtctcttattccaaagaaaacagcaatattgaaatactaaccagtcaaacatcaaaagagtttactttcctggttgtagatcatgggtgtggaattgctgaaaaagataaaccttttatctttgatcgtttctactgtgctgataaatctcgcacgaataaagctcattttgggttgggacttagtatcgcaaaagaattggcaaaaatgctctctggaaaaattggattttcagatacttctggtggtgggacaacattctttttgactctacctataaaataaagtgtttgatctgtgcggaaaataatgttaatacattcaacaaacataaaggaaagtatctttattcttcaaagtaaggggcaggagatctgaaaaggtctcctgcttttttgcatccaaagacaactctgtgaaacacttctctaaagctactacaatagatagggcgcaaggccctgtgccagaagcactgtgagaccttacgccctgttgcagttctatcctaaaaatactttgccagctgcttcagaccgcgccggatgctgtcacggacacggcttgggtctacaccctccgctactgctatctcgctcacgcgcatacccaggtaataccgggcatagatccgcttggcctgtttctccggtagagccatcacagcggcatagagctgctcccgcagctgcttttcttccagaagcgtttccggtgtttggggcttcatcaggatcgcattttcaatgccattgtcgcagtccagggagtaatgcgccttatagcgatacatcctccggtcataggcagcttctgcacgctcagcagctcggatcgtctccagcacatcttctgttacttctacaaagtgatcatttttgtaaacgtcgggatataagtccctaagattgactttcttcattatgtacctccatttcgattcacgggcgattgacgagtgaaccgaaaggaggcggggatcggcagcgacatacttcgggagctttcccgaaaaatcgataataaaaagcgccagctccctgcaatgggaaactggcgcaacaaaaatgactatgattcttctgttttagttggaatgataatgccgatagatagtcatacctccccggaggaggggcaaggctttttttaattggtgcagctcatgggtgctatgaataacgaaaattgacatggcggtatcctcccatataccgccctcctgattgcataagcatcggtccgaaaagcaaaaagaaacggcggctctgattttctcaaagccgccgctacataggcgcgtggaaatgtatctgctgtacgacggctttttttcttttgccgtcgtccggcagatagcatctgtatttagttgttgactaaggcttttattttttcgactaaatcaaaatccgttttgcagcagaagtcaccatagtatagtttggctttttgctctaatgccctgctgttatcgccagacatcagcagaaagggtgttttcaaaccttgttgacggattttttcaagtaaatccaaccccgtgccatctttcatattgaagtcggagcaaattgcatctactgtgattgtttgaagtgtatccaatgcgtcctcaacgcccgtagccttaatcgtttcaaattcacccgatagcacggatgacaggatttgcagatattccgtgttatcatccactatcaatattcgtttcatatcattctgccgcttactccacggtaatctggattgtgcctgaaaagtctgtaccgataattccgatgtagttcgctcctgcttgaagctgaacggcaacacttccgctggcagattcagaaagcacttgctcctctaagtccggggaaatgtaaatgagctgacagtttccgtcaagggaatcaagctggtatcggatcacaatttcacggcactcattttccttgaggtcggtgtctgcaactaaaatatcctgtccgttaaatccagttacagaagcgtcataggtggcccgaaaaacatcattatccgaagttcggctaccttcaaaggactgataaggagttatgagagcgttgcttttcccgatcaccacatcgttgcttaattgctctgctccatccttgagattttcacctaacctatcgaggccggagcaggcagtacaggccagcaaagaaactgcaatcaggcagcacccaataatttttccaattttacgcatagccgtttcctcactgaacgaaagtaaggaacaaggcaagtgcaatgattcccaccatcagcagtgcccaaaaaacgctgatcgctgtggatgcgatattgataatgctacggctttccttgctccgcacacataccactgaaagggtcagacccagcaggacaaaaacgatattggctccggcccaagcggttctgattccggccgacagcgaaaagtgcaggagtgacggggcaagagcagccagtggcaatatgctcacaatgagcgcagcgacactgactgattgaagttttttcttttccatagttttacctcatttcttttttcccaaattgggtgacagccagcgcgaaaaacagaccaaacactacaatcgcacacggcaagaatggaaacatcgaaaatgcggcatcggaagtttctgctgtaaaatcatggagcgagcaggatacgagataaccgctgtaacagtacgggtaaacaatccacagcagcgtattcgcaaccaatacaccgggaatcacaaataacaaattcaatcccacggaaagaagcggcttttcaaacagtacggtgattgcccacatagccgcaatacatggcagcattgtcagaaacaatcccaagcaccatttcaacagatacaggatcggtaaggtttctgttattcccattgtctgtgttgcaaccaccccagcgattacgaacacaacaagaaacaccaccatttccatgaatagataaaaggtaagcacacaaaattttgcaatggataatgtatagcggctgaccggcaatgccaacattttcagaatcccgttatttcctgtttctctccctgcgatcatcacgcagactacaatcatgctgaatgggagcaggtagtaggcgtagacaagcgcactttgaatgaacatggcaggccacgcattagtgtattccggcgtaaaatagttgctcaaacttgcaaccccggaaatcactaccaataaaggcgcaatgaaaatcaagggtataattttggagcgtcttactttcataaactcgattttgagtaaatccaaaaaattcatttctatcatccctccttactcgtagcgtctgtatttcgctaaccacaatcctacggcaaggaacaacagtgtttctgccaaagcaacaagggtaactatcagatctggctgggcgctcatagctaccgccggtttcaaaataatcacaaaaggatgtaccagcaaaagtgccacctccgaatttgcaagagccataccacttagaaaaccagcgacaccaattccaagcggcacccacatattttcaaaacgcgaggaaatcaacagcataaacgacagtaccggcatggatgtaataaaagagtatccggcaaagcgcaccagcgtacccatttcaaatgctccgttcggtaagtctgtcattccaatctgtgcaagtgccaaattttgcagcatgattgcaaccagaaacatgaccgtcagaatcaggaatttgcacaggtacatcgcgggaacgcttacgggaagcatatacatcttcttgacagcgcttcccttaaactctatgttgtagatcatgcaggccgcaactacgatgccgaacaggttcagcaccataatcatgccgtaaagctgggtcagcaggacatccatcggagccaacggcagattcaaaagcgtgtccttccgcacaatgaaattgacaaatgcgtaggcagctcccaagatgccaacagccagcaacacggggattacgccggttcgcttttctttccgaagttcgattgccagcgttttcataattttgccctctgctttctatccatgttgtctttctcaaccatagaaaggaacacatcttccagattgtccgcggcgaagccagattgcagggcgtattgacgaagatcattcatgctaccctcaaacagcaaccgcccgtggttgagaattccaatgtcatccgcaatcaattcaatttcagacagcatatgggacgagatcagcaccgtgcagtcgtaaaggctgggcaaagattttaccagattgcggatttcgtggatgccggacgggtcaaggccgttggtgggttcatccaggatcagaatcggcggacgccctaacagtgccccggcaaggcccaagcgttgcttcatccccagcgaatacttctttgccagccggtcgccaaactcggtcagccccaccaactccagagcatcttccacatcggcttttggcaaccccaaaatgcggcggataatatcgagattttccctcccggtcaggtttgcgtagaaagacggagcttcaatgaaagagccgatctctttgagaatggcaatccgatcacccggaaactgcttcccgtcaatggtaaagctgccctttgtcggtgcagtcaggcccagcagcattttcatagtcgtggattttcccgcaccgttggggccgaggaaaccgtaaatgctgcccttgcgaatatgaagcgaaacattgttgaccgagatgaaatttttgtacttctttgtcaactgttccgttgtaatgatatagtccatagaaacatctcctttcgatgtttttatgatacaacttcaacctgacatctacattctcctgtccttacttttaccttactttttaagaagcgaggctgcaaaatggacagcttatgatataataaaaacaaaggaaatcagattggagaggatgctatggataattcctttttgcatagtaaaaggctcttgttggtagatgacgagcaggagttattgaagatggtatcagatatattgaaagatgcgggatttgaaactgtccttaccgctatgtcggtcaaagaagctgttctgaccgccaaagaagaaacccccgatttaattgttttggatgtcatgttgccggatggggacggcttttctctgatgcagcagctccgcacttttagcagtgtaccgattatttttctgacagcaaaagacgaagcatcagacaaactatcgggcttggggcttggggcagacgattacatttcaaagccctttatgccgcaggaattattactgcgtatctatgctgtgctgcgccgaacctataaagaggattctccgctgcttgttttagatgggtgtacgattgatttcagtagagccgaagtccataagggtagtgaggttatttccctaactgccaaagaacacaccttgctggaaacccttgcccgcaatgcaggaaaaattgttaccgtagatactctttgtgaagcattatggggtgataacccttttggctatgaaaacagcctaaacgctcatgtccggcgtgtccgggaaaagattgaaaccgatccatcaaaacctgtgtccctgataaccattaaaggattgggctataagctgatatcaaggaagtgatgccatgagatcatttgcaagttatatatcgaaacatcttgcgtcttttgctgcctttatcctgatattgctgtttcttaacgcagtagtatttagtctaacttttcaaaagattgtgactgaggattatggaaattcttccccgcaatctatgttggaaatgactgctgccgccgctacaccggagcgattattagacaatgcggtacaaaagctccggcagaatcatatttgggcaatttatctcaacgctgatggacagtgttattggtcggttgatttgcccgatgaagtgccagaaagttacactattcaagatgtcgcattgttttcaaaaggatatattgaagattatccggtttttgtctggaacaccgatgatggactgttggtattgggttatccaaaagacagctatacaaaactcaccagcaattactattccatttcagcacttcgacggctccccgtctttgtgcttggaatgttgggattggatgtactgtgcctcttttgtgcctattatttctccaaacgcaaaatcatccgtaataccgaaccgattgtgtctgctgtggaaactttagcagacggaaagccggtttcacttcatatcagcggcgaactatcggaaattgccaatagcgtgaacaaggcttcttctattttaaacagacaaaatgaggcgcgggcgaactggatcagcggtgtttcccatgacatccgcacaccgctctccatgattatggggtatacgggccgcattgcggaaaatgaatctgccagcaagaccatccaagaacaggctgaaatagtacggaagcaaagcgtaaaaatcaaagaactggtgcaggatttgaatttagtctcacagttggaatatgaaatgcagccacttcacaaagagatggttcgcttatccaaattgctgcgatcctatgtagcagacctattgaacatgggaatttccgatagctataatattggaattgaaattgctactgacgctgaaaacactatgttagaatgtgatgccagattgatttcacgagccgtgaataatcttgttcaaaatagtatgaagcacaatccgctgggatgtaggattctgttatctttaagacggacggaaaatgccattcagcttattgtgcaagacgatggtataggactctccgaagaaaaactacaagaactaaaagaaaaacctcattatttagaaagcacagatgagcgcttagatcttcgacatgggctggggcttgttttggttcgacaaattgtagcggcacatgaagggactatgaccattgacagtaagattaactgtggatgtaaaatcatcttgacttttgactcttatagatacaatcccaaaagcccacttgagttaagtcaaaagcattttggatatttatcactagcacaaaagaagccggaaatctaaaaaggtctcctgcttcttttgcatccaaagacaactctgcgaaatactcctctaaagctactgcaatagatggggcgcaaggtcctgtgccagaagcactaagacctcgcgccctttgcttattctatcctaaaaatactttgccagttgcttcagaccgcgccgaatactgtcgcggacgcggcttgagtctacaccctccgctgcggcgatctcactcacgcgcatacccaggtaataccgggcatagatccgcttggcctgtttctccggcagagccatcacagccgcatagagctgctcccgcagctgcttttcttccagaagcatttccggtgtctggggcttcatcaggatcgcattttcaatgccattgtcacagtccagggagtaatgcgccttatagcgatacatcctccggtcataggcagcttctgcacgctcagcagctcggatcgtctccagcacatcttcggttacttctacaaagtaatcagttttgtaaacatcgggatataggtccctaagattgactttcttcattatgtacctccatttcgattcacgggcgattgacgagtgaatcgaatggaggcggagaccgacaccggcagacaaccgggtcatctccgaaaaaatggcaacaaaaaacgccagatttccgtgagggaaaactggcgcgccaagaacagccattattatactgaattacatggaacgataatgccgatgcaatgttatacttgcccggaggaggagcaatgctttttttaactgatgtagatcgtgtgagctttgaaaaagcaaacgagacacggcaaaataacctccaatcggctaccgtgtccctgcaagtcgttataggtttgtgtaaacgcaaagaaacggcggctctgatttctcaaaaccgccgccaaagtaagtagagtaagcgcacaaaatcaacctgcccagctacggtttttttctttccccattgggcggggcaggctctcgtcgtatattgaaataaaaaaggaccgataaccacaagtaaatttaccttgtgtattatcggctctgcgtctgtgcgtctggctcttgaacgatggataaatttagttttcttaccgtaatcagggtttcatgtttgcatttaggacaatataacggaaagttttccagtactgtatcatcgcggattttcaatcgcgttttgctgccgcaaaaggggcataaaatccattctatcttcatgttatcttcctctgtgcttggctttcttcttttcctgccgtatggcaaactgacggtctttctcagcctctttctgctcacggctcttggttttccgttccagcttacattgctcatgctggagtttcaacgcctgctgtgcctttgtgccaatgcctttatcttgcagttgactttgaatttcgcgctgcattcgtttgggattgatttttcgctctatgactacttcgatctggatcgggggactgaatttcaatttatgccaattcttcagcagaaaatcatagacctcatactatacttaattctattttctatttctcgacactaataactctctgtgcccactcacgataaaatgcttcttcatgtgatacgagcaatacagtacccgcaaaatccataagagctgatttcaatgcttcctttgcctgaacatccagatgatttgtgggttcgtccataattagaaaattgcagggaatcagtgttagcaaacacatttttactttcgcctgctcacctccacttaatgttccaatcgcttgcattgcgtgcttactggaaattccacaccgggctaaatgtttgcgaacatcttttatgaccatatcaggatggacattggaaacaatttgaattggtgtctgttcaggttcgtcccatattaagtcctgctcaaaatatccaagggtaacttgatcggaaaatttgaaatgaccttgcatggacgggatttgtccaattaatgtcttgagcaaagtagatttcccaattccattaaagccagtgataacaactttttgcccgccttttatgctaaaatcaatatctgatagaactggatagtgataaccaactgccagatgtttgaccagcagatgctccgtatttgtcagcggtaaaacaggaaaatgaaaatgaggaataatctctttctgttccaaagcctccattttgtccattcgatcaagctgtttttgtcgccctctcgccatttttgcttttcgtccagcaatatttttcctaataaactcctctgtttttttgatctccttttgttgcgctgagtattgacgaatgtaatcttcccgcaacagtgtcttttttcgcagaaattcagaataagtgccataatactttgttattgtgtcattatctatatcgcagatacgatttgcgattttatccaaaaagtcaaaatcatgggaaacgactaaaaaagcattttccaaagaggataggtattccgccagccatgcaacatgatctttatcaagaaaatttgtcggctcatctaatagcaatacatctggtttttcaagcagtagctttgccaaaatcacttttgctcgctggccgccactcatttcagcaatcggacggtcaaggccaatcgcaagaagtcctaacccattggcgacacgatcaatagcggtatctatcgaataaaagtcatgggcttcaagctgttcctgataacgggcggccagttcaaggcttttcatatcaccgtcagcagctttttcatagagctgcaacgcctgtgcctccatttcaaataactttgtgaaagcggatttgagaaattctttcatcgttaaggtatggtcgatttccgcatattggtctaaatagccaatcgtagtattcggttgccagacaatgcgcccgctgtctggtatgatctgctctgtacagattttgattaaagtgcttttgccggttccgttctgcccgacaatgccaatatgttctcctttattgagtgtgaagcctgcatttttgtaaagcaggttttcaccaaaagaatgtgttagtccttcaatttctaataagctcattttaaaaaaacctttcttaatatatttggaaaaaagaaaaggcagaaagcagagatacacaagtgtatccgccttctgcctttggcatagcaacgccaaaaacaaaaggctatggacaaaacattgtccatagcctcgtacacattataactgcatggaaagccattttctcaaaatgggtataaaatcccctttatggcttcccgatgaaatcgaaatgcgtcatttatacgctatactctgcacaatgtttcatcggtttggattgtacagagttgattttctttttacgctgatcggttaaatgaaagttcatatcttgctcccctttggagatatatttttatatagaatagcacaaacattcttctttgtcaatcttatgaaataatatatcatgtaatatcaaatcatattacattgcctacgctaacaaaaaaattgaagaactggacacccgacgccagaccatttcaaaggcaatcgctgaattgagcgttgaaatcatatctccccagcagataaagaagttatcctattatctcgacaactgggacagcatagattttgacgacaaaagaaaagccgccgatggtttgatctctacgatcaaggccaccagcgaccgtgttcagatagagtggaaaatctgacatttctgctctatcgcccctcatttctattttatcttgtttgtaccccttgtacaccgatgttttcttcactcaaagatagctttacaaaatacacctctaaggctactacaataggtagggcgcaaggtcttatgcagaagcactttgagaccttgcgccctctgttattctaccctaaaaatactttgccagctgcttcagaccacgccggatgctgtcacggatacggcttggatctacaccttctacttcggcaatttcatttaccgtcattcccagatagtatcgggcatagatccgcttggcctgcttctccggcagagccatcactgcggcataaagcttctcccgcagctgcttttcctccagaagcatttccggtgtctggggcttcatcaggatcgcattttcaatgccgttgtcgcagtccagggagtaatgcgccttatagcgatacatcctccggtcataggcagcttctgcacgctcagcagctcggatcgtctccagcacatcttcggttacttctacaaagtaatcagttttgtaaacatcgggatataggtccctaagattgactttcttcattatgtacctccatttcgattcacgggcgattgacgagtgaatcgaaaggaggcggggatcggcagcgacatacttcgggaggtttcccgaaaaatcgacaataaaaagcgccagctccccgcaatgggaaactggcgcaacaaaaatgactatgattcttctgttttagttggaatgataataccgataggtaatcatatctccccggaggaggggcaaggctttttttaattggtgtagctcatgggtgctatgaataacgaaaattgacatggcggtatcctcccaaataccgccctcctgatcgcatgagcatcgttgaaaaagaaacggcggctctgaaatatgttatttcaaaaccgccgtaaggccactgtattttgttttggcgcataaatacccagtcgccgaaacaacggttttttttattcccgttgggcgacttttttcttttagattgttttgagttcccgactataataagctatacctgcaattacaataagggctatacctgatccaatcataatccactgcaagggaagaatatcagccaaagggccaaacatagccataccaatcggtaaaaagccagcatacatcgtgccaagtaatccaaatacacgcccctgcatagaggtgtccgttttttcttgtaacatagtggtaattgctgtttgcaccattgttaatgcgactccataacataccattaggccaaggtaaaaaataaaattctttgaaaagcccattccgattgcaaaagagccaaacgcaaaaattccaactgccaaagtttttcctcggtgcttaaaacctccccatgtactcataataactccgcctgccatcatacctgcgaaccctactacttccactgcggtaagataccagtaagtatcaccgaatactcgccgaacaagaagtcctgcaagatagcctgctggaacacaaaagaaagtgaatagtccgtagatgattaaaagctttccaattagtttgtctgcaaaagcgtatttgacgccaattttcatgtcagaaaagacgctggccttctcaatggaagtattttgtttcggaagtgccaagcaggacaataggcccgttcccaagatcgccgttacaatgtctatcataagcgtcgttctcaatgtgctgattgcaaaaactgcacctgccgccgctggagccgcaaaattaacaatagactgcattgttgcattgatgccgttgtaccgcataagctgatcttctgggacaagctgtgggataacggcattgaccgctggagtttgtattcctgcccccaaggatcgtatgaccgacataacaagcaaaccgccgagcaaagcaggctccgatgaaatatgcggaattgccaataccattacgaaagtgacaaatgcaatcagcagatctgcgcctataatcaatttttttctgtggtatcggtctgcccatacgccgcctataaatgaaatgagaaattgcggcagataggaacagactgtaaatgcagccacccacacgccgctggatgtctgcatggttgcataccaaacgagcgccatttgaacaagcgtagagccaaagagtgtgatacattgactggttaagaaaaggagtattcttttctgccagccggtgcgttgcgtgtcatccatgttgtatatcctcctgttttttaggagggagcacaaagcgctgcgtgggatagccaaactctgtcagcaattctttttcggcaaaaccaagttgcaatagcatatctcgatgccctgtatcggccttgtcctgttctcgaaaggttgttgtgctgatttcctgccctggaagatatgtttccaataaggcatccaagaataacttttgaagtccgcgatttcgatattgcggatgtacgccaagaaattctatactgcctggagaataggtaaatgccatagctccaatgagaatatctccctcccttagcacaagcgcacgcttttcgtcaatactttcttccagtttagctaaatagtcatcttcatccattacaggatacccatcaataacaagccgcattaagttcatccaatcgacaatagctttcttttctgctagccgaatatcctgtattgtaaattccatagccgtcgttcttcgatgtaaaatgaaccgcaactgcaaaggataaaagctccgttcttcacgatactccgcaggtggcgatttatacatggccttaaaagctaatgaaaacgattgctggctctcgtatccgcagataaaagcaatttctataataggtttatccgaaaagaccagaagctttgccgcctctgtaagctggcggcgttgcacataatcatgaatcgtcattcctacggtttcggtaaatagtcggtgtaagtgatattttgaatagtgaacagcctccgcaaccgtttctaattccagctttccgtcaagatgactttcgatatagtcaatgactgcctctatgctgataactgattgattgcccatttatgttccctcctttccatcaagcataataacaaaatcaaaaaagattgttttaataattattgcgaattttgaaaatcctctctaaattcagatgggtcatttattatactgtaattatacttgaaaaacaaatattaaaaatagtctttggttctcgttctaccaaaaatcagtataatcattcctatcgaccggcataataaggttattcctttgtgcaaatcggcacgatagaatatatttgaggtgagtgattatgccgattgatgatttgaccgctttggggcaaaaaatgcgggaagcccgaaagaaaaaagacctgacgcaacaggagcttgcggatctgagccatgtatctgtcaagcagattgccagcattgaaaagggacaaataaatccgtcctatttgattttgaaggcattggcaaaagtgcttccgctctctctggacactctgatcaatccaaatgtttctccagaagatgagggagccaatcagatgaagatgctttattgtagctgtccgtcagaaatgcgtgaaaccctcttgcaccatacacaggagactgcgaaagaactaacagaattatccgagaaatttgaaacgaattgagccggtgagtgaaatttgactgtttcctcactggctcctttcatttctgcaaagaaaggggcaagcaatgcctgtgttaatacacacaggcccgcagagaagaaaatccctttgtgattttcctctctgcttgcttgttgagggcagcgcccccaagcccctttgaacacagaatttcattctgtggctgcgcgttctgcgaacgcttttgaccaggaccagcttaccgctggtcgtggtctttttctttttcaacatcctgttctacctccattttcagcactcgatctacatttgcctttgccgttaaaagctcccgcatttcctcacgggaacgccggtactcggcataggtctttttcttttcttcaagcaatttcgcgtactccgtctgcaactctttgaccttgggaagcttcttgacgcccatctcatcaaaggcattcttagcagcctggtggagcagaatttcttcctcatgttcttcccggaatttcttagagtaacccgccttgcggtatgccacatagacctcacgagtcttggcataatttacgatgtgagtacgcagaacagcgatctctgccatgcgcttttcagccgctttgatctgcgccgaaagttcattgtgatgtgccgtggcagccgtagccttttcttccaaaaccgcatactccagcagattgttctctgacaggtaattcatggtctgcgccatttgtttcagattaaaaactttagcccatcgagcatagcctgcaccttttccagcctgcaattttgcctgaatgtccaccagcagattgatcttcggcggctctgcctgtgtgactgttttctttcgcagggtatgtgctttcttccctaagagaactgcccgcaaatcttccaatccatatccttcgcccagactgtccatgcgggcggctttctcccaaccagagagtttcagtcgatacgattttccgcactttgagacttcacaaccatactcttgcaacagcttcagcagttcttcaaagtcagcaggactttgtgataatgcgttgtcaatcgccacacgcagcagctctcgatgagagggctttgcctgatctcccagccacttgttatagctttttccgtgaggtttcggattctctacaatggacagtccgttttcaatgcagattgtatcacttaaccggcgaaccgccttggtgctgccccaaaagtttcggaatttccggtcatattctaagctgaccgatgaccagataatgtgattatgaatgtgcgacttgtctatgtgagtgcagaccacaaaggcatgattgcctttagtaaaacgctttgcaaattctacgcccagccggtttgcttcttccggggtaatctcaccagggcggaaggactggcgcacatgataggctatcacatcatctgcgccgcgcacccgtccggtagcagcaatgtactgctgctttgccagaaggaattctgcatccgcagtccggctgtcacacgcataaccggtaataagtttgccgttatctgttttctgtggatttgctacatagtcgatgatgtcactgattgcccgactttctgtgcgccccttgccaacatgaagcggcatgattcttgtagttgccataatagaaggccctcctctcataaatatttttgttttagctgaactctctgcttctatcgttgcaataactttctccgctgggtataataaaaaagaacattctacaacctcaaaggagggatttctatgatagaacagctcattgctgaagcaacagaatgtgatttcaaagttgctctcgaaacaaaaaagccaaaaagctggttaaaaagtgtcagtgccttttccaatggaatcggcggcactctgtttttcggagtctctgatgaccgggagcctatcggcttgtccgatgttcaaaaggatgccgaagcgatcagccgcttaatcaaagaacgtatcacaccattaccacagtttatcttaaagccattgcaggaagatggtaaaaatctgttggctctggatgtttctcctggccgcagcaccccatattattacaaggcagacggcgtgatggaagcatatatccgtgttggaaatgaaagcgtaattgcccctgattacattgtgaatgaactgatcttaaagggaaccaatcagtcctttgataccctaacaacagacgcggtaaaaaaggattacagctttacacttctggaagcaacctatctggaacggaccggtctccgctttgagccatccgattatgtttcctttggtttgactgataaaaatggactcctgaccaatgccggaaaactcatgaccgatcagcacacggtttataactcccgtatgttctgtacccggtggaatggcttggaaaaaggctctatctttgatgatgcgctggacgataaagaatacgagggaaatttgatttatttactgaacagcggcagtgaatttattcgcaataattccaaagtccgttttgtcaaaaaggcacagtatcgtgtagacaagccggattatgctgaacgagctgtgacagaggctcttgttaatgcgcttatccatcgtgattatattgtgcttggcagcgaaatccatattgatatgtttgatgatcgggtggaaatcacatctccgggcggtatgtttggcggcggctcaattcaggaatacgatatttacagtatccgttccatgcgacgaaaccctgtgattgctgacctgttccaccgcatgaagtacatggaacgccgtggaagtggcctacgcaaaatcgtcagtgaaactgaaaagctgcctggatacacagcggcatataagcctgaattttcctcaacagcaacagatttcagagttattttgaaaaatgtgaattaccatcttagtcagaaagacttagtcagtgaccaagattgtgaccaagttagtgatcaagataaatcacaggacatcctacacgcagtcttggatttttgtataacagaaaaaagcaaacaagaaatttgctcgtttattggttatcgaaatctcacttattttacaagaaaatatttgaatcctctactggcaagtggccagcttaaaatgactattccagataagccaaacagtcgaaaacaaaaatatattacagttcgttccgaataaacagagaagcagggcattgggtctcatctcccattgtcctgctacttttcattctaaattatattcacatcatttacccatacacccaatcctggattgcaaatttcaaactctgtaccttgcccagcagccagatcgcagccagcggcaatcccatcgggctaatcaaaaaagctataaccagcaaaatcacaccattctgcggggaataggtaataagcacagccacgccaagcagagcaattaccgtgctgagcagaccaagcaccagaccggatatgtagatcagccccatgcagagccagacaaaaagcgtcaacaccaaaatgaccggtgcagttacgatcatcagcaagcatttcaaaatcttcattccagttctcccctccaacgctccagataccgtttgcacagggcatccgcttctctctcatcatcttccgtcaactcccgtctgcctttggtcagttcaatctccacataagtccggtaatcatcagctaagagattgaacagttccttgggagtatggcacacctcgccagagcaatagtgaaaatcttggtcaaattccacccttacacatccgtgacggctgatataaacttcgatggtctcgtctgcggttaggtaatccgcaaaaatctccagcaccttttcaaaggtcagcatctgttttcactcctttgctacgcttcttattctactcatattatccggtacggacaggcaaaagacaaggatacagacaaaaaaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagggcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcggctatatccttcccaccaccgggcggattccggactttcaccggttagagacgtgcgccgccgggcgcacagaaaaagcggaggaaggtgcggcgaagaaacgccgttcctccctccgcaaatggagtatctatccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccaactccttcagctctggcagttccagcttgaccacataaccatccagcgccattttccgcagataagcgctcaaattctctgtcccgtattgctgcatcttttgatggatcagttccagttcttctgcggacacccaaaacaaaaccggcacatcccgcttgcgctttgccatggttatcgctccggctcccgttttttcggggcggcagacttatgggcgggcagctcctgtttgagcttatcccgcactgagggacgggacggttccagtttttctctctgggtacggctgcgctgctgttcttcacgcaccagatcaataaaaccatccagcacagcagggtggctgtttaaggcataaccacaacggacggtttcgggattatcgttgggaatggtcttggcccattctttgttgcgtcgggagtaacgcccatcccagtcctgaagctggaccgtgttagacagaaccatggacacacgctccatgccataggtctcgatcacaccctttgccgcatcgtggctgagatacattccgtcgaagtgctcccgcaccgccgcttcaatagactccttgcattggcgatttacattgttggaagctcggtactgctccagctccccatgttctctcgcataggcagctgaatggggatagatcggtgttgttcgcagttcctctttagctctgcacacatcgtcggcacggttctcaatgctgtcccggatcacatccatgtgaccggtctccagcttttcaaagtagcggtacacatccgccagcggcaaagaagattccaaaagtgcctgagcctgggtgtcggtcaactccagttcctctattgccatcacgatgtcctcgcggatggtgtactcataggcatggtttaagacttcttccgggggctggcttttcagccagtcccggaacttgtcctgttcggcagccatcttttcataaagagctgtattcagatcgttagtattcatgttatcgcacctcctcatgctgttttggtttcttgtctgtactgcggggttgcaccgggcgttttaggttatccagcaccgaaggccgtgtgcttttggcaataacagactcggtgtgtgcctgcccctttccgtcgatgttgagcagggtatccaactccaccagacgggcgtttttgcttgtcagttcttcttcataaaggaatggctttccgacttcctcttttgcggcagcctgctgctgatagaggttatccagctgtgcctttgccgcctccagacgctggggcatctgagtgagagcattgtcgatacgggtaagatttccgcgagggtctgtaccaagggttgccctgtgggtcatctgtcctttcagcaggagcgtatattcctgtttccaagcggaaaattccacggacatggcataaccccggtagctgccgatctgcaccggatcggaggttttgacctccttgcaggcatccaaaagggctgcaccggcgttctccttatcggtcagcaggtctccacgaatctccataccggcaaagccgtcctccgggtgcgggtgtgctgccaaaacctccaggtcagattcaaagcccttgataaagcctttgtgcttttcaatctcctccgggaagtatttgagcagctggtcctccagacgatattgcttgctctggtggtcggctttcatcagcttcaggcgggatacctccacatccaaatccatacgctccttgatgcggggatctccagcacacagagccttgatctcggcaaaactgagggctgtttcatccacatcatcgcaggaacgcaccggcgatttagaagtcatgatctggctgatgaatttctgcttattctccaccgtctgccagaggtatgcatcaaaggttccttctgtcacatagcggtacacatggacaagaggattcttgttaccctgacgctcgatacgacccttgcgctgggcaaggtctcccggtctccacggacagtccaggtcatgaagtgccaccagacggtcctgcacattggtgcctgcgcccatcttggcggtgctgcctaagaggacacgaacctgaccggtacggactttagagaacagctcctttttccgcacttcggtattggcttcatggataaaagcgatctggtcggcaggcatcccctgggcaataagtttctgacgaatatcgtcatataccgtaaaggccggctcctgctccggcagaggcacagtgccttccaatgcgtgaagcagtggattatccagcgttttcgccgccttgcttgcaggagcttttgcctgtggtgtagaaatgtcgcagaacaccagctgggtcagcttgtcagctttgccgtcccgccagatctgcatgatgttgtccacacactgattgacctttgtgccaggttcgtccggcagcatctggttgacgatcctctggtcaagccccaacttacggccatccgaggtaatcttgagcatgttatcctgggacgggtcaacagttccgctgtgtaccagcgatgcacgctccgaaagagctttgaccatttcctgctgatgttcggtgggctgcgccacgatgttgtggtactccacttccggggtagggagatttaactggtcggcagtcttaatgtccgccacttctttgaacaggttcatcagctccggcagattaaagaacttgctgaatctcgttcttgcccggtagccggtgccttccggtgccagctccaatgctgtgacggtctccccaaatcgggaagcccagcagtcgaagtgggtcatgttcagttcttgcaggcgttcatattgaagataacgctgcatggtgtaaagctcggtcatggagttgctgaccggtgtgccggtggcaaaaatcacgccacggtttccggtgatctcatccatatagcggcacttggcaaacatatcggaggatttctgcgcgtccgatgtggaaagaccagccacattccgcatttttgtgtatagaaacaggttcttgtagttgtgggcctcgtccacaaacagccggtccacacccagctgctcaaaagttaccacatcatcttttcgcccctcggcttgcagcttttccagtctggcttccagagactttctggtacgctccagctgcttgacggtaaaacgctcgccgccgctggcctgcacctctgcgatgccctcggtgatctcgtcgatctgctcatagagaagcctttcctgacgctcccggctgatagggatacgctcaaactggctgtgtcccatgatgatagcatcgtagtccccggtcgcgatacgggcgcagaactttttgcggttatgggtctcaaagtcctttttggttgtgactaagatgttggcagaaggatagaggcgcagaaactccgatgcccactgctcagtcaggtggttgggaaccacaaagagagatttctggcacaagcccaggcgtttggcttccatcgcagcggccaccatctcaaaggttttgcccgcgcctacttcgtgtgccagcagggtatttccgccatacagcacatgggcgatggcacttttctggtgttcccgcagggtaatggccgggttcatgccgccaaaagtgatatggctgccatcatactcgcggggaggggtagagttcatttcttcgttatactggcgcaccaaagtctggcggcgctccgggtctctccagatccagtccctaaaggcttcccggatagcctgctgtttttgggcagccagagtggtctccttggcgtttagtacgcggcgctcttttccgtctgcgtcctctatggtgtcatagatacggacatcccgcaggtttaaggaatcctccagaatcttgtaggcgttggcgcggctggttccgtaggtggtataagctgccacatcgttgtaggatacagaagatttccccttgatctgccattcagcagtaaaggaggaatagttgacctcgatactgcgctggagataaaacggggtgttgaaggtctcgtacataaactgctggatgtactccttgtcaatccaggtagcgcccagacgcacctcaatttccgacgcatccaggtctttgggctgggcggcggtaagagcttccacattgactgcaaaagaagggtcctgctgtgccgcccgctgcgcctgacgcagtttgcggcgtacattgccggaaaggtattcatcagcagtcacataatggggtgtgccgtcctgttccagctgtcccggcacacggaagatcacgccttgcagttctccggccagtgcttcttttgtttttccggtaagccgactcatatagctcatatctacgcaggctttttccgagatggacaccgccagtgcttcgcttgccgtatccacagtagccactgcctgatggggcttgatggtccgtttggtgaacatgtccgccttgcgctccagctttccgtcctcgtcgataacttccagcgcacagagcaggtaataggaagaatcatctgcataggccagccggtttgcacggtcgttgatgagaccgtatttggcagaaaagctgtcatagagtcggttcagttccgcctgtttttgggtaatgatgctgtctggaaccgctgcatccatctgaaggtcgatcagttcctgcacacaatcacgcagtcccacaagacctttcacacgggcttcggcggtagcgttgagatcagggcacaccatgcggctgttttcccggtagtacacctgcccgtctacaatggcataagaatagttcttcacattggggtcggcaggaatggaggtgtcaatggcttcgccctcgcccagctccggcagctctgcctcctgataagtgccatgaatgtacttcacagcatcatgcagctggtcggaaagctccagtccctcgatagggttcacggtgtaatccataccatgagcagtgcttaccggttcctgtctgcccagcaccatttccgggtggtcgataaaataccggttgatggcaaacccatcctccgtttgtccggtctgagtccattccggcacgatgtccagcggacggtcccgcttttggagaaagatgatgtccgacaccacctcggcaccggcattctttttgaacgcatcattgggcagacggatagctcccagcagttcagcacgctgggcaagatagcggcgcacagtggaatccttggcgtccatggtatagcgggaggtcacaaaagccaccacaccgccgggacgcacctgatctaacgcttttgcgaaaaagtaattatgaatgttgaaattcagcttgttgtagactttgtcattgacctgatactgaccaaaaggcacattgccgatggcaaggtcaaagaagtcacgcctgtcagtggtctcaaagccgcctactgtgatgtccgccttgggatagagctgctttgcgatacgcccggaaaccgggtccagctccacaccgtacaaacggctgtttctcatttcctccggcagcataccgaagaagttgcccacacccatagatggctccaaaatatttccggtctcaaagcccatgcgccccaccgcttcatagatggcctgaatgaccgtagggctggtgtaatgggcgttgagggtagagcttctggcggcggcatattcctccggggtcagcagctcttttagctgagcatactctaaagcccatgccggtttctccgggtcaaacgcatcagagagaccgccccagcccacatatcgagaaagaacctcctgctgttcggggcttgcctgctgtctggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataagatgcttcctcggcagctttggcattggggaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccatggtctcggaatggaaggtcggggattcggtagccggttggggctgctcctgtccaaaaccgtcctgctgacgggcatacatcccgcgcagcaaaggcgcaacctcatcccagcggaaatacagcatagccagacgcttttcctctgcatccatgacttccagttctatgccctgtgccgtggtacggtaatcggcaatatcgccggtctccagattcagtgtctcaatctcaccggaataggctctgctcagccagtaggcgatctcactgttgctcctgccggattgcagcaacgtggaaagctgctttttatctgcttcatccatcaatccatgggccaatacatcccgcaagtcttgatctgccttgtccgggtcaatgggaagaaactcggtatagtaagcattgcggcggtctgcccgaagcagctgctcgaactgttctttgcgctctgcccgatagatgggatataccatgccggtgggcagaagctgtacggtgtcatccctcagctctgtgatctgataggcgtcatcctcgatatacacggtatcacccacggcataaaccggggcggctgggtcataggaggttctttgcggagttgggcggcgaactgcgtcatattcctcatcggaaatagcaacttcggaagtctgctctgtctcaacagctgcgatctgctctacatctgacatcacctgctggataaatgaggaattgtccagtttttccggatctgccacctgtccgttgacgatccctctttcctccagagcttcccggatggcgatagggtcgatattgtcaaaacgatcctgttcttcttcggtatagaaccggtcctcctgaatcagctgggcaagcctgcgctgtaccttcggccagggcagctgtgtttcctccgggcttccggcacggacaacgaacgggctgttgctgccaccgtattcctgagccagccatgcagcggtatccttctctcttgcatggtctttcatatagcgggcaacagcgtgtttactctcgatattgccgttccatgcacaaagggcagtatcaatatcttcctgagaaagagggcgcagaagctcatggagctttggataggtctcgtcgatcacttcccggtgtaaacgctgacggaactccggcacatccgaatagagtcggatcagctccatatccttagaaccaaggactgcacggcgcacagcggcattaccctcgatgacagcattttcacggtcagaatgaccgcaggcattgcgatatgcggtatcctcggaaatggcggcagtcaccacaggcttatactgctcaaactgctccccaagggtaggctttggtgtttcttcatccatctccggctgctgggcttgaatggcatcttcttcggccagttcctgttcagactggatcttgtcatactgtgcctgttcctgttcggtaagatagcggtctttctggacaagtgaggtaatgcgcttggcaaccttttcccagttcaagtgaacatccgggcagtcctgctttttatagtgcagtcctttcccatcgtgatcttcgccgctgtgtgttgcgccggacagggcatgagagcgtccgccaatgccatactcgtctttaaggaatctcactttctccttatccgtatggtttgccatgaagaacgcatagatacggccttttcctccggcgaaactgctgccgccggtcatagcggcgtcgatctcatcctcggtaatgaagtgctgaacggttggcacttgggaaaggtctgaagaaaaggtcctgcgtggcaggtcaaggtccttcaggttctcccagatctcccttggtctgtgatagtgaaaacgcaacaggtcacgatcctgctgataggcagtccagaaggcggcgtattcttccttgagtgtctggcggaaagccgggtcactcagctgctccgtcaggcggcgtgtctcctctgggaacccattgcctttgatctctgacaggcaggacaaatatccggcttttctggcgtcctcgctgagatcgtgatacagatgccagagcttttccgagagaagggagcgttcatagcctgccgcttctgcaagctccacattggaggcaaactgaccacttttcaaaagctccccgatacgctctgcggcactctcccaggaaatgacctgggcagacctgtcataacggacagacttcccgtgggaaagatggataccatcctcggcataccatgcactcacactgccaaggccgttaccgccgtgatacagcgttttcagtatctcggcaatctcagcggtggttttctgcttttcaaaggctgcaaccacacgctctctctgacgatctgtattgcctcccaaacgcagcacatggtcaatatcattttgggcaaaagaaaaagcagaggatgtatgcgctacattctctgcttcatctatggattggatctgctccgcttcggagaggaacaggtttagggtcagctgttgataagctccgccatcaggatctcctctgcctgggctttgcaggtgttcatcagccccacccacttcatgggatcgctggctttcagttcctcggtggctcccgcttctttcgccagctggggcatcatctgctccagtctgctctgggcgatctcgtcgatctccagaaggtgctggtacagcttctcgctcagcagcatctggttgtagaggatgggacggtgttctttcaggtaggttttcctcatcctgccgtacttgcccaggggtttctctggctgctggctcagcttcaggtcgggaatctgatagtctccgttctggatgtaggtcatgggattgttcatcttgcttgctcctttcttggttggcttcgcgctctgcatttcggacggtaacgccgatctgccgcagcacctgctggttgatctggctgaccgctgttcccagcgccccgatggtggacggggtgttgaaatcaaagatcgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaagaagtcctgctgatgctccgtccagtattcctcggccagttttccggctacctccgtgagctgtccggcaaggtcatcaccggaaacatcataggtgcgctccagcatggcctgcacggaatccagatggcgctcctccaactgccacagccagggagtgcgggaatgttcacgggttccggtgtcggaaatgtcaaagacataacgcaggcgaggtctgtccccggaatcatccaccagagcgattcccttggaaccgcgccttacataacggcccatcttttcattccacaaatcgtactctgcacaggcggtggcgtccggtcgctgggcgtagatcatcagctgctcatggaacgggtatttgtaaaggcgggaagcagtggtgagaaaccccgcccattcctgccagctccccgtgagctgtgttgccaccttgtccgccatctgtgcataaagttcagctttggttggcatggtattctgtcctcctttcggtttttgggtaaaagaaaagcaggaaacctaaaagatttcctgctgggtgaaactgtgaatattaaattatggctaacctattggttatacaaactgcattttaattggtttcttgtaactgactgtacagttgactatcaatcttataaattccctgatagggctgttcaacatagtatttcccactgtcctcatatgcaaaaagtgtacttgttcctgtctcaaactgaaagtcaatcttaatataactttccgcttgtgggacatcttgaacactttcctttttagtcggttcagaactggaaatattggcgattatttcacttatccaagttttgtctgaatgacttactgtgttttccccgacagttatatcaatagatgtaatctcgtcggtttggggtagcgtaataggatctgccttttttccacacgcaactaaagtcaagacacaagcaagacacaaaaatatagaaacatattttttcataagcatattacctcacatagtttgtttgcaccattataacatagcagagcaaaaataactatcaagagaaagtaaaatatttgtgaagtcaaactgttttcactaaacatctcctaaattcaagataatcgtcaatgcacatacaaactgaaatttatggtgttacatcggtgttcctacttcaatcaaattaccgtccaaatcataaaaacgaattactttttgtccccaactatgtgtcataagtttattaacatattgaattgagggataagaccgttccagcttttcaacgaatgcttctatatcttgttcttcaaaatataattcacaagaattacttttagggataatatcctttcctaaaaactttttccaaattttttcgtcttgaagcacaagtccttccgttaaaatcatgttaccgtcattgtcaagtaccaaatcaagaccgaacagatcattgtaaaattgttttgatttctcaatatctttaacaacaattaaaatgttctttaatttcattgtctaacacctctaaataaattcatatttattgcttacattatacttcatccatctctctaagtatagtgggcttttgtaaaaatgtgagagaaaccgccttttcttcggacaatttctctcactatgtcatcttggtacgataaatttactgttcaaaatccgggtacagctccaactcggcaaagtcctcatcggtcatcgcacaaagcttcgtaagggcgctgtcggtcagctctctcagttccgtttcctccggcgaaagctcgccacgcatttcatgcaggctgtcaatcaacccggtgcggctgccggtattgtaaatgcacatcaggttcatttcctcaaaagtaaagtttcccatatcaaatctccctttctgcgctctttttttgcgctgtctttttgtgttctgctttgggctggcttttcagctggttcacaacggatttcttcttttcccgttcctcccgatgggtggcggctgccagatccatcagggaaatgggctgaccgcttcgggcctgctgttccagctctgccaccgtaggctcttttgtgccattgttgatgatgccgtcgatcatgccgtaatcgtcctctacggccatctctgcatttttcagcggattttccggcaggaatccggggatctgggtaaaaccaacgctgtcgcagtaatgacaggataccttactgtcctgtttgatcgcaacgatgtcgctgacgctcatggagggactgtgaaagtctacgggtttttccagattgaattgctgatagagtttttccagctgctccggcacagtgccagactcactcagcggagcggtgtagatgaggtcataattgctgcggtctacggaaacatcatgggactctaaccagtccagattcataaagcgcacattctgcggatcgtcacggctcacctggtagatggcaaagcagtttctgttctgggagagaaatgcctgttctcgttcctgctgatgttcctgacgctccatgaccttttcgtggaactgagggcttttctcccattcctcgcggtctacgccgaaaagaccgccatgatccatgatctcctgtgggtcaaacaccatgctctccgtattgtcctcatgcagcacatagacagtcaaaccagcggcatccagttccagcgcccgttctcttgtaacagggagcatcccgtcataagagtaaccgtatttctgcatatccggtgtggagacctgctcatccggcgttgggtattcatccagcgcctgctcctgtgcctccggcagctgggaagaagcagtcatctgactggcctctgcctgcatctgctggtaggcagcttcctgcaaagtctcgatcatggacaacggtgcgtattttacagagtctctgtccagatcgttgtcatcacaaatctggagaactgccttcatgcgggaaagctccggcatatccagctgaccgccatccagctctttcatggacgcagcatcgtaaagggtgtagtcccagccgctgtcacagggctggatatgaagataggtggcatcgtcgatcagaaacaaagcctcctgctggttggcgtctgcccccagcgcctccatttcctgcatggccgcagccagttcctttactgctttctgtaccagcggattgtcacggtaatagtcgattgcctgaatagtgtccaggtcaatggtctgcccggtcaaaatcggaaaaggtccttcatagtcgcttccgtctttcagctcaaaaccaattcctttgatcccgttcattcgctctgccggaatctcctgataaatgcggacagcttcctccaaagacaggttatcgtggtattctccgaggtttggaaactccatgcactctgctacatagtaggttagattgccggtcggctgctctatcggggcggtttccggctctgcttttgtattggggtcaattccacgctctttgcagatttccttatagtggcgctcaatgtcacagatcaaagtgccggaggtcttattgatggtctccaaactggctctcagctctttcagttccttgccctgactccagcttgcaatatagccgaagctgttttctccggtctcaatgccaaaatacttgcagaccgcataggagatgctttcagcctccacttcctccgtgtggcgatttttgattgcctgtttttctgcggttggatcttcctcaactgcaagacgccattcaaactgattttcgtccacatagcgccaatccatatcagaagcaaactgttcagcttctctttctgtggcaaaatccagcttgaaatcatgcttggttccaccttcgctttccagcacaaccttccatgacggtagcatttcatattttttagggtcatggagcttgctgtgggcaatctcgtggactgtggccgaaaccgtctgcacctcactcatgccctgacgaatggcgattttctgatgatcggcagaaaaatagccgtccgtatcggcggccattgcttcaaaagtgatcggcaccggcgcactgcggcgcagagcctccatgaatgcctcataatttggcacattgccggaaagggaggaagcaagctccggcaaaggtttcccatcggtctggctcacatcaaataccttgaccggacggaacatggggatctcgatttctttttcctctgtaacaatctttccgtctttatccagaatcggagccttggtatccgggtccagtttctgctcctcgattttcttcttatacggtgtaggggcgatgatggtaataccatgctcacccttttttacatgacgctcaaactggtctttccacttattgtatccggctaccaaagtggcgtccggcttctgcatatagatgagcatggtgttgtttaccgaatagcggtggaagcgggacataacggacagatagcgcatatacttttcgctctcgaacaattccttgataccctgctcgatgccatccgtgatttcccttagccgctctcggttggtgggtttgttctcagccatgattttcaatctcctttccaagtgtgtgatttctgctgtgtggtctgcaatccatgccttttgttcttcttcactttcataaagaaaaaggtccagcaggtactctacataggttttcttctggattgcttccacaaaacgggggtgcagttcttcctctggtgtccggggagaattgtcgatctcccattttttcagcagatagtagtaatcggacagtacgcgataacaccgctgccggtcctcccgaaacttttgtgcctcggttttctgccggacatacttcctgcggggaggagcctgactgtcatagatcaggccaaagtcctgtgccagtttctccgccgcttcttttgaggagaggtcaaagagctttgcggtaaagtcgatcacatccccatctgcaccgcagccaaagcagtggaaccgctggtctaccttcatgctggggttcttatcatcgtgaaagggacagcaggccataccatttcgtttgacctcgatcccataaaactctgctgcttctctggtgctgacagactgcttgactgcttcaaatacattctctgccatgtgcctttaactgctggactttctcacagggggctggtatccggcagctttcgcacgctcactggcagctttgcggcgttctgcgctgtatggctccctgactgatacacaccgcttggggacggtaaagttatgggcgtcctttcgggtgatctggtcggggtgcttttttgccagcagttccagcttctccatcagacggggatcgtgggtgtagacctcagccattggttctgcctggttatagaggaaaatggtttcccgttccactaaagagagcttcatcggctgcctcctttccgctggtcaaattccagcttaaagttggcgtactgtccatcgtcctccaaaaccacagtggcatcgtaggtcttgccagttttctcagaatataggcccgttacacggacacggccatctttcagcagtgcagacaccacagccttggtcggctgttttttcttggcagcccaccatttgttatttttccagattgcaaatttgcaagaatcattctgacagaagaagcctttttgcagttctgcaacttcaccgccgcagcgagggcatttgcctaccacatcacggggcggggagaacaggtactcggttcccttgatgacctgataagtccccaccagatctttcagcatggtgctgatcccgtccaaaaactcctctggggcaagctgcccgcgctcgatctcgcccagttgatactcccactcggcagtcagaagcggcgattgcagttgttccggcagaacggtgatcagggaaactgcatcgtgggaagggagaagctgcaccgttttcctactcttttttcgttccagaaaaccggcagataccagcttttccaaaataccggcacgggttgccggtgtccccagaccttttcgctcggcatcctccggcatatcctcttttccggcagtctccatcgcggacaatagggtgtcctccgtaaagtgctggggcggactgcttttgccttctttgacgattgcagcagcaaccgaaagggtctgtccttcggtcagctccggcagggctttctctgcgccatcttttttcggctctgcatccttcattttggcacggtaagcgtcctccagtgctttccatccgggatgcttcaccgtttttcctttggcggtaaactccccaccggcacacgctgcaatcacaacggtttccgaatagatatggggctgggctacggcgcacagcagacgcagggccaccagctccagcactgctttttctcccgcaggaagggcagaaaggtctgcatccttgagatttctggtagggattactgcgtggtggtcggttactttcttatcgttgatgaccgtctgcggatcacaggtaatggcgatccctttgcgaaacggcatagcattggcaaccagattcaccagcactggcaggctgtctaccatatcgccggtcagatagcggctgtcagtacggggataggtgcaaagcttcttttcatacaggctttgcagatagtccagggtctgctgggctgtaaatccaagcaggcggttggcatctctttgcagagtagtcaggtcataaagggcaggcggcttttcggacttttccttgcactccacctttttgattgtggcagctgcaccctgacaggcttctttcagctgctcggcagcagccttatccgccatgcgctccccggatacggtaagaccgggcagctccagcgccacggtataaaagggaactggcttaaaggtgtcgatctcagcttctcgctggacaatgagcgccagggttggggacatcacgcgcccgatgttgagggtgcggtggtacagcacggaaaacagccttgtggcattgatccccaccagccagtcggccttagcgcggcaaagagcagcatcccgaagcccgtcatagtccgcaccggggcgcaggtttgcaaagccttcccttatggcggagtcctccatcgaagaaatccagaggcgtttcatgggcttttggcagcctgccagctcgtagacgctgcggaagatcagctcgccctcgcgtccggcatcgcaggcatttactacctccgtcacatccggggcgttcatcagctttttgagaatatcaaactgctttttcttatcctttcccaccaccatctgccaatgctccggcagaataggcaggtcatcatatcgccacttggcgtacttggggtcatagctgtctgcgtccgcaagaccggccagatggcccacacaccagctgacacgccagccgttgccctccagatacccgtccttacgggcagttgcaccgatcaccgccgccaaactctgggcaactgatggtttttcagcaatcaccagcttcatattcttcaacctcccattcttcccgcacaggcgtgtgcagttttttctcaatgctgttttcctcatccagaagcaggttataaccaaaccggtagtcatagcggtacagtttccccagcaggtcattgatgatgatgcggcaagccaaaatgacacgagttttatccacctgcatcagctggtagcgttgataattgctgtaatattcttcatggcggtgggtattgcggacagcatcttcaagcaaactttctactgcatcctgacaaccatcctctttttcaccctccatacagttcagaagttccattaccataggaaagctctgttcatccataggagcttctgctgcaagaaaaccgatcagggcagataagagcagacgggctgctgcctgttcctggtccgtcaaaacagccatcgttttctccgcatttggcagaatcttatcttccacaaaatctgccgcgtcaccggaataaagctgacggacagaatctatggataatgaaaccatcacggcatcctgagaaaagtcaaaggaatcttcctgttttgcttttctccgaagtttgtttaacatggtagaaagaatgtcgccgccaaaatacacggcgatcaccagcaggtcaaaaacagcaatcagcttgataaatataatcagaacactcatttttttcgtttcctttctttgagccatcgttccatctcacggtggcagacacctacgcaggggcttccataatttccgcagccataacaggggtggctttggggcaaagagggaggacgggaagtttccttcccgccctccggcctgcgtgtcatcatgcgttcatagggactgtctgtgaaacgggtcatttcacgctgtcctcgtcatcttcttctgcgctgcccccgtcagcatccggctcgtccgactcctcatcctcggtttcccattcctcggaatcttcctcgccataatcataatcgtccagactgtcattgcccttggtcttaggcttgttcttaacgagcttcaagtaggcaaatacaccacctccaccaagcagagccagcagcaggatcagcgcagccgggttcagtccggcaggcttctctttttctggcttcggtgtttctgccggaggttccggtgcttttcccgtacatttactcttatccgttacacagaccggacaggccgtattgactgcccctgcttcacatttcttcgtgcagctgcacaccgcaggcggctcctctttggcatttccatcttccatcagcgccatcaggtccgcttcatccacctggttcagaaagtgaacagcagtctttttatcctcattggccctgtcgatcaggatataaaaatagttgcctgccttggtggtaacggtaatgagctgcttgttgccaccaaaatcatccaccagagcggcgttaccctccggggtcagcggaggtgctttttcgggttcttccaccaccacattgctgtcattggtggtatcctctgccgggggcggcgctgcgccctgggcaaaagcgggaatggtaaagcccgatgccagaaccagcgtcaggcaaagggcggaaagtgttcggagcaatcgtttattcctcatagctgttttcctcctgttcgttgttgtcatccatcatactgccggaaactgcgccgccggacagcatggcgctcagctgggcaggggtcatacgcagtgcgcgcaccatctgaacgatctccagattttctgcctcggttttctgtgcctccagcgccttgagcttttcctgatactctgcgatcttctcacggacctttgtaatctcctggtcaatgcgctcaattttgttctttgccatcgtctatcactccttcttaaaaatctctgttaccagttcatcaggccgtagcccttaatgctttgataattcaggtcataacttttgatcttgcaggcatcgccggaatttccctccacggtataaacacggctgccatccgtaccgatcacgatacctacatggtctgctgtcccatccaaatcccagtcaaagaaaatggcatcaccgggggcgatgttctcatatcctcgtgcgccccactgtccatgagactggaaccacggaacaccctgccactcacagcctgcaaagcgcggctcactttttcctgcctggttatagcaccaggatacgaagcaggcgcaccattccacgcggctgtcaaaaccgtaccagctccagtagggataaccgcccacattgcccacctgacttttcgccagttccaccagctgcggattgccggggcgggtgccgttaatgaactgcacaccggacagatcttccgagccgctggtatcaggggaaccgccgccaaacaacagcggcttattgcccatggtctgtcggtagacctgatacatttccatctgctccggggtcagaagttccgacgccacagcggaaatgggcttgctggtgagtttcacattcagaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgcctgagcgctctgccgggtgtagccttgcaagacggcagagagaaatgctgccagctcatgagggtcatggccgatcataccaaggtcatagcgatactcgtcataccctgggtgactgctttcaatgttgtcgatttcctcctgcaactgggcttctctggctgcataatctgcctccaccgccagcatttccgggtcatccgacggataggtggtgccggagagaacggaaccgatgctctgcgccatcatggagcaggaggatatggtattcatcagcatacaggtaatgaggaacaaaacccctgccatcaggaaacccttcttgtggcgcatgacgaatgcccctgcctgctgtgccttttcttttaccgtccttgcggcttttcctgttttagatgcagcctgggcggtatttccagcagtctgaccggcgtgtttggcggcggcatactgctttttgatggcctgcttttgctgccagcgggaaagtggattgctggcaaactggggattttcctgcaaagatttctggtacagaacatttacatttgccttttccagttggcgctctgcctgtgctgctttgcggtacggcttcagcttgtggctgtgatagccctcccgcaccagataagcgccggtctccaccgcttcctcggacttgtgggcgctttccacgcccacattgtcctgttctgtttcccggatctctttgtggagtttgcccgcaaccagatggacgggagcttccttgatcccttgagaaagtttggagggtggctttttcttgtcctcaaaggtcaacttcgaggtcttttttccggtatccgggtcgatgaccgtctgcctgacctttttctttgggatattggcctgcgccttatctgctctggccgcagctttctccgctttacggatcggcttttccagtgcagggtccgaccgttcctcatcagtaaagcgcaggcgcggctccttattcaaaccattctcccagcatgagggaggacatcatgtagtgcagctctgcataaatggccattcccacaggatcgttgaacatacaaccggacaggtaggcgtaaaactgtgccaccacatcagacaggatcttcgcttcggttccttccagaatcagaccgcccatgccttccttggcacggatggcgctccaaatctctgccagacggagaagccccacctgaccggtctcattcagttcggctgcctgatctgccgccgtgcggcactcacttaccgcatcggccatgaccgtaagcagctggctgcgctgggcatttaccgccctgtcaaaaaacatcaacgggttttgattcaaaatgttggggttcatcatcattcatcctccttctttttcagttcctggggtttggtggtcataatgcggtacagctcggtactcttcgggaagtggtccacgaaaggcagaattgtggagccatagaacagcaggccctcgccctcaccggagtgggtcacatagctaagctggtgcgtggaaatgcccagctgcttggcaagtatctgacggtctccgcctgcctggttgagcatatacacgaagtcggagttttcaaagatgttctctacctcgcggctgctcaaaaggtcgtagggtagggtaaaggcgccttgccgccgctggcggtaggtttcctacaccctccctcggaaccggacttactcctctcaaagtatccggctccccattagtaattgacgtattgattagtgtctgtgtattctttcatggcacttgctgcaaacgacaagcgtttttctccgcttctttttcatcacggtttcccaatcagaattacccaattcgtttaagttccgtataacgtgaacctcatacaaatcggcttctttacacccacataattcacaaactctggcattgagccgctgtctgatagtggttttccagctaaatttctttctctgatagatgatgtcactcgcttcgccacgcttacagtcagcgattttaacggggcgcacacgctttgtccctgttttggtttcataaggaacagaccatgttttcccgtctttatactggcgaatgattttgcggatactggttttatgcttattagcaatcgtttttaagcaactgtactccatgagatagcagaagtagtccaacgtgtgataatcacaagccagattgtaatagttgcataaccctcttgcttcggcattgtactgttccacaatttcataatccgcaaggttgagaagtccggctcggtgtatcggctgaaactccccgttttccttttggcgaatgactttctttgcaaacatgaatttttcaatcttttccgtatggggaatagacaaggcaactttcatgtgcagggtacgggattttctccacgttccgtttttcattctgtgacctttgacttcctgatttctgcggacacaaatatcatagccaatgaagcggactttttcggagctgtgcgttatcagcgtcttttcctcgctcagagttaatttcagctctgtgcttagaaattcagcgatttcggctttcaattcctcacattccgtttttgtgccacacacgcctgccagccaatcgtccgcataacggacaaaagtaaacttcttgttgtcggcaggtttgcagggcagatttctcatagctttcttctgcgccctatgctggtcaatcagttcttgtcttgccgcttcatcagaggtatggtcaatccagtaagacagtctttttaattctttgcttgccgcatgatattccagtgtctgatatgcagacctcggcttatcaaagagttctgcgatttcccgaaacttcttgtccagctcattcagatagatatttgcaagtatcggggaacagataccaccctgcggagaaccgctgtaagtggcgttgtacttccaattctcgatatacccagctttcaaaaactggcgaatgatgttcagaaaacgactgtccttgattttcctgctcaaaatctcaatcaatttttcgtgattgatgttatcaaaacaaccttgtatatcgccctcgataaaccagaccacgcctgtgaagtcagaagaaatctgacgcagtgcggtatgacagcttttgcccggtctgaaaccgtgggaatgactgtcaaagacaggttcatagatagcttccaaaatcattctgacaacttcttgcaggagcttgtcacggaaagacgggatacccagcggacggagttttccatttttctttggaatatactcacgccttacaggattagccttgtaggttccgtcctttagtgactggattaactcttttatatagaagtcactgaaaccgtctgcggtatcgtcgtcgataccctgtgttgttgcacctttgtttgcataaagtttctgataggcggcgtagtaaatatcttcacgaagcaagtatctgtaaagtcttgtgaatacgccgtctttgtgttcgctggaacacttttcaatacgctctaaaatttcagatgttggtttcattgaggtttctcctccctttcattcttacattttagatgttactaactggctcccttcgccatgtaagggtcattacccctctcggactactatggagcctccgttaccatatccggcaaatgagccggacttaggcaatccccagttagcactgtgcataggttagtgaagattgtcggatatgctttcggttcgttgtgacgtgttctcacgcctgtttcataacgtgttggcagttatcccgccgtgaaagatgacgtgacagcgttatgacatgggtttcaggacttttcccacacctgcaaaaaacaggaactggaaccttacattcgataaacccaatcttatcctcatatcttcttaacattaggaaacagtcgcacctaagtcctttggtgactattcctttttctgccatgcgctgttcccgtaaaggatttctccttagtcggtaaggcagattgtttcgcacactgccgtgtgcggcagtaccttagactgctttgcacagcgccctatctgggcgcactttgacattctgggtgatacctgtcggaataccaccccatttacggaatcgcttccagatttccactgtataggcagcggtctgttcctccttcaaaagcaggtgcatctcgtcgatgtagtaacgggtggacttgtgggcagcgcggttgatggtaacgcggttccacacctgatcctgtaccaccagcataccgattttcttgagctgcttgcccagttccttgatgtcatagcagacaatgcggttgttgatgtccacattgctctggtggttgaacacattgagggagccggttacatagatttcaagggccgtagcgatatactgggcttccttttcctcctgttcccgaagcaggttatataggtcctccaaaaccggcatattctccgggcgcgggtcattgaggtaagtctgatagaccaggcgcacacagcggtcgatgattgttttctgcaccggctgcaagccctccttaccgcccacgatcagctcacacaagctgaggataaaatcagacttgagggacagtgggctttcatcatccgagtagtccaggttcaggtccatcggattgatgtagttggtggaggtaggcgagatcttgatgacctgcccatgcagacgctcaacaagaggtgcgtactccgcttccgggtcacagatgataacatcatcattggtaagcaaaaagcagttggcgatttctcgttttgcgctgaaggacttaccggaacctggcgtacccaaaatcaagccgttggggtttttcagcagctttctgtctaccatgatgaggttgttggacagggcgtttatgccgtagtacagagcttctttgccgttctggaataattcctgtgtggtgaacggtacaaagatagccgtagaactggtggtcagtcctcgctggatctcaatctgattgagtcccaggggcagacagctcatcagcccttcttcttgctggaagtccagcctggtcagctgacagttatacttctgggcaatggagcctgcctgaaagatgttgttgccaagctgacggggattgtccgctgtgttcagcaccagaaaggttaaaaggaacattctctcgttgcggctctgcaaatcctgcaagagttttttcgcttcactgccgtaggtagcaaggtcggatggaatgatgtccatgtcgtatccggcacgaactgcttttttctgttcctcgatcttactgcggtccagatcggtaatcttgcgctttaccgtcttaatggctttcacctgatccaccgactgaatgtgcatactcacaatgagcgagctttccatatccaaaaaatcagccagcagacggtcattcagctccggtgcgagaatctgcaaaaaagaaacagccccgtatttcttgcccatacggaactgcttgccggtgcggaactcaaaggagcttggtgcaataaaatccttcgtggacagaccggaaggagccagccagtcccattcaaactgaaatgggagctgttcatccatgtggaatactgcatgaagctgagaaagcctttctttaccgtccagcgttctggcagctacaccaagacgcttgaagttattaagtatatcggtctcaatacgctccagacggggcttggcagctttgatgctgtctgcgtcgataccaaaagtcaggtatttggtcttgatgagaccgttgttacctctggccagctgattttgcagcattgtggtgtattcctcgcggatactgtcaaaggcatccctctggggcgggatggaaatggagttagcaaaggtctcctccgatgccgcaaggttcaaaaaagacagctggaaatgaattgagctgtcaaaataattaaggaaatcacaccacccctcaaagattgccgtcttatcttcgttttgggagagctgatagttgatgtcctgaaactggatggtctttgtgtagtggctgtccgatactcggcagattccatccggccacatccgttcataagggatactgtcctgcgcagattttccttttttgtccgtgcggttagcgcgggcaatggccgcttcgatctgcttcttatcggcgcgggacagctttttctttgtctttaccggctgcacagtttttttctcggtttttccgaacatccgatgcagccatttttttattgcggtgaacaatgtcatacacctccttatcgagcatttcctgccgctttaatacggcataaaagttattggtctggtagggacgctgctttggacggatcacagctactttgagaatgttgcccacgatcttttccaggggctgtccatgcttttcgtacatagccagcaggaagaagggcatcatgaccagcatcatacacatggcagccatgctgtttcccgcaggctcacggagccacaagaacagcggtacgcctacaagcgccccggcggtaaagcagaccagctgccttcgggtcagattgaacatgacctttgttttgacttttgttaagtccttgggtacgggtacataagccaatgtagaaacctccttccgttttagtgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagcgccagcagggatcggaggtaattctgtcccataccgccccattctttacccatcattgcagccattggaacgggagccaccgaagtcacaaggtagatttcgatcatacggccataaataacgataaagatacagatatataacgcccacatagtaatgccaataaagagggattggaaccacagtccgaacagcggtcccagatccatttccatcagcctcggttccagatcggtcataactgaggaaatgtcaatggacgcatccgaattgataatccctgccgcctgcgccactacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcatcacgatagccagaatcacacctgcaatcggcaccatgatggagttggacagattctcaatcatgctgaaaatactgccattccatccctgtggggtctggcctacctgtacggatatatccgcgacctgctgatttacactgtcaaacatccccgaaaggttgctcataataccgcccaccagcatttctttcagccaatttgtcagggcttcaagtaagaaatccatacggtgtcaacctcctttccgccgcccccgcaaagctgcgggagcggcaaggatttcatacggagacgcttagacagagaaaagcccggagagcagaggtacaaggaccatgccgactacggctacaccagcaccggccatgagctgtttcatacccaattaggtgtaaaactctgctcgatggcgggcggcggcgtacaaaaaatctatatggtgtttttaagagaaccgtcccggcgggacaagtcaggcagtgacctgttccacctctgggatgggtttgagattaaaatgaatttcgatagaaatgtgtcttgttttatcttcgtcaatgcgctcatgcacgacgatttctttgattaagcggttaagggtggctgcgtccagctctgtgatgttggcatattcctgaatggcttccacccattgttttgcgtcattggcaagctgggcttcatcggacagccgcttcctgccctcggacacttttgctttaagctccgtctgctcggtctgtgtcttttccagcatggtgttgaaattctgctcactgatacgccctgcaatcatatcctcataaagccgcatgaccattttatccagaacctcaatccgttcctcgtcccttgtaagggagcgttccattgcttcccgctgttcccgctgctcggcttcacaggtattagtcaggcggtcggcaaccgctttcccgtccatcagggcagctctggcacattccctgattttccgcagcacatgactgtaaagggtgtcataatcaatccggtgctgggtgcagtggttctttccaaaggcattgtaggtcttgcaggagtaaatctgctggggatgttttgcgtttgtgtagcgtaccgtcagagacttcccacactcgccgcattttatcagtccggcaaacaggctgatttcattggtctgccccggacgctggcgggatttcagcttgttctgcacaatgtcaaagctcatgcggtcaatcagcggttcatgctgtccttccactacaatccagtcctccggcttcttttccccaatcgtgccgattttgaaacggtagtcctttttctgggaagcaatcgccccagtgtaaacgggattcatcaaaaggtctttgataacggaaaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgtttagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcgatgtcgttgttatcccgcagggtgtcgataccgtcattcatggcgatatagcggacaccgtttcttgggaaaaagtcctcaatcaaatgccctgtttgcaaatagttacgccccagtcggctgaggtctttcgtgatgacaaggttgatttgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgctgaaccgattgttctgtattccatttcgttcatcatagccatttacccacacaatccagacggtatctggctctgttgaacctcatcttcattatacttcaaatctttctttttagcaagatattcttttgtatttgttttgccgtatttctgggaaatcaggctgacgaacacatcggtggcgtccagttccccgtcaaatacggttgtcacttcaatcttggtcttatttttcgccataggcagttatcctccatacatgaaaatagccagacagagaacggtcggcaacgaagtccggcaacgggcttcaaaagaccttgcaaacaatctcaatctggcgttgattactatttatacttttcttttatttttctgttgttttggttgtcagagagggaaaaagcccggaaataagggattttccccggcaaccggctcggcaacgggatagcaacgaagtcggcaacgggctgtcattttcagaatggaagctccatctgctctgtgacctccacaaaaccgtccatagatttttcgggcgggttgtcggtgtccgttgccgggatttcacgctcccagcccttttgtctgccgtattccgcaaacatcctcggattggaaaagtagttccacccggtaatgcactggttcataatctcgttgatttcccggatttcccattgtttcggctcgtcaaaggcatggttcaaggcttccttgtagagctgcttggagcagaccatgctcccggtgtacttatcaagatacgcctgtatcatcccggctttggtgtcctccggcataaaatcccgctggtgttctttgagataccgctgcatggctgggctgaatgacagcttgaacatgccgcttcggtaaatctccattgcttccgcccacatctggctgatataggctctggaagcggcttcgtcctccaaaatgtgaacctcggcttgctccgggtacaccatgaccgggataaatcggcggttgccggaacggtcaagggggagaaagtcaagggcgttggaagtgccgccgaacacgcattgacgggggcggtctgccgggtgagtttcatagggaattttgtaaacctctttctggcggcttagaaaggacttgatttcctcaatgctcttggcattggcggttgccatcatttccgacatttcaattatccagtgaccttgcagcttgcggtacacgttatcatcgtccagcttccgcaaatcatcggaaaaccactcgtcccggactgccagcagccggaagaaggtggatttgccagccccctgaccgcctaccagacacagcatgatttcaaatttgcaccctggctgaaaggctcgtgagattgcacccagcaggaacagcttcaaggcttcataggtgtaatcgtccacatcagctcccagaaagtgccgcagacagaagcggatgcgctcagtcccgtcccatgcaaggctgttcagaaaatcccggatggggtggtacttattctcattcgccacaatcccgatggcggtttcaatctttttctcactggtaagcccgtaggtttcctccagatagagaagcagatacttcatgtccgtatcggtcagggctgtgctttctctgtgaaaaccgatgggctttatgatgtccttgcggtcggtcaggatgttgtatgcgatagccccggaaagcagcgggtcacgctggaatacggtcaggcagttccgtatgctctgacggacaccgcctttctcggtagtttccagccccgccttgatttcctcaatgctctggggcggctgcatagcgttcatggtgttttttagttcttgctgcgtctgcggctgcaagctctgccattcgttgttcaagctgtatcacatcctttccgtagtccgtaatcaaagccgctttttcctctgtctccccgaacagcagcacatccagcagatattccacttgggcttgcttctgtaaggcttccacaaaccggggatgaacggcttcctccggggagtgcgggacataatcctttctccatgccctaagcaggtggagataatcggcaaggatacggaagcagcggctctttgcttcctgaaactgttcctcctgggatttctgccggggcttgggcttttttaccttccccggcggtttccagtcctcataggaaagcccgaagtcctgtgccagctgtacggcggcttctttctttcccagcccatacagggcggcggcaaaatcaatcacatccccatccgcaccgcagccgaagcagtggtaacgccgatccagcttcatgcttggggttttatcgttatggaacgggcaacaagccatcccgttccggcctacacggattccataatgctccgcagcctgtcttgttgtgacggactgcttcacagcttcaaatacattcaaatcaattcctccttgtaaaaaagaaaaggcacttatcattctcaatctgaaaatggcaagtgcctgttaaagttccatatcctgttgtttgtgtttcgtctgcgccggggcgtttttctgtgctttcttctcgtccgccttatcctgcaagacttctttgaggggctgcttcttgggcggctctttgctttcttctgtgccgggtgtggctttccgtacccagtagcggatgtcccgcagcttcttcaaatcttcctgcacctcggtcagcggtactttcagttctgcgatttcgctgagaagcgtttcctgctcctcttgcagctccttttgggtactgtccttatcgtccgggtgcttggcaaggtagtcagcggctttctcataccgggcaacctccgggtgttcctgtttgaatttctcctttgttttcttaaaaaatatcttctggtacttctcataaacagccttacattctttgcagtctgtccggctggcaagaatcccgtcaatcactttgctccgggcttcctttggcttcatctgattgcggtaatctgcggctgatttcccggaagattccagaaatgcttctaagtcctccacagtggaaagccccttttgccggagataggacagggcttcgctgactgcctttaagtcctgtgaagtcccccggttctgtccagcccttgtccagtccttccgttcttcctttcgtatcgccatatacttcatcagcagattgggaagaagtgttgcttcctccgccgccttttgtgcaagcagctctttccgtttttcgcccagctcggtaatccagcctttgaggttttggataagctgccggatggacttcatcaggctgttggcggctttgatttcccggttcaggtttccgatattcgtctggataccccgcttttccatctgccggacagcagctccctcatggacagtagggactatatcaagcccctgtctggcataggaacgcaagtccacacgctccgggcggtcattggcttccagatagcggttctggatgacctcccattcatgccgccagatttcacaatacttctggtcgttccagtcaaccgtatcctccttgtggcttttccatctgccggacggaagtttgatccgttccccattctcgtcaaggtcataaaccttgcggctcttgggaagccatttcccatgttcgtccattgccctcatagtgagcaggacatgggcgtggggattgtgtcccggcggatgggggttatggattgcaaaatcagcaatcatgcctttggaaacaaactgctgctcacaaaactcccgtacaaggacagcgtactggtcaggcggtatctctctggggatggtaagcacccaccgccttgcaagctgggagttccattgtttctccaccgcttcggcggcgttccatagggtattgcggtctgcatatttctgtggggcatttgccggaagaaggatttcattgtggacgataccacgcttttccgggtagtgcttcacttcctggtcgtattcacagaacagcttttcgccgctctggtaggcagcggcggcaaccgcagactgctgttggcttcgctgtacaatcgagatttcgttgtgtggacagggcatttcgtgtccctcctttcggtaattggtggatggggtggcgttttaccacctcatttggggcagaaaaaaagcaggagaccttttcagatttcctgctcggtggtgccgccggtgggcggctggtattcagttttgaaagttcgggtcagggtggcccgatgatgaaataaaatatctgcatgaagattattcaacttcttttagtaattcttcaacagaaataccgtaaagttttgcaagtgcaaaaagatttgatgtggaagggtcggatgttccattttcccattttgaaacagcctgcctgctaacaccaatcgtttcagcaacaaattcctgcgtcattttgcactgtgttctgtgtactttgagtgcttcacccaacgatttcctcactacggatttttcctgccgtacatcttttgaatggatatatttgagtaatgcacgaacaataagggtaagcaaaccaacaaagatacataagaaaattattccaacgattatcataaatacggttactttcatttgaccacctcctaatgttgctgttggcttcatttctctgtacggatatatttaagcaatgcacgaataacaaggataagcaagccgacaaagatacatgagaaaactattccgactacaatcataatgatgtttactaacatttggatgacctcctcctaatatataagtgtagggtttcagtacccaacagccagttgggacttaatcctctcattgtttaagctgtataatgattaggcattggtatgacgacacctcctaggaccactttaggtgtccgcaagaaagccagtcagccagcctatcatttgcagccgttcgatttatgcaggttggactgtccttgtacatgtccgtttgataccccaggagattgaataagcagtgaggaatgctggataccatgcaaattcattttcaggaggtacattaggatgtacaacgctgtcggtattgatgtctcaaagggcaagagcaccatcgcagtcctgcagcccggaggcgtcattgtcaggaaaccctttgatgtttttcacacttcccaatccttaaaagaactatcaaattatctggcttcacttgaaggggatacaaggattgtaatggagtgtactggcagataccatgagtccatggctaactccctctctaatgccgggttttttgtaactgtcgtcaatccgcatctgattaaaaactttggtaacaatacgttgcgcaaggtcaaatctgaccctgctgatgctaaaaagatagcacgctatacccttgacaactgggctgaactgcggcagtattcatgtatggacaatacacgtaaccaattgaaaaccttaaattcacaattcagcttctttatgaagcaaaaggttgccgcaaaggcaaacctgattgcactgttggataatacataccccggtgtaaataaactgttcaacagccctgcccgtgaagatggcagtgaaaaatgggtcgattacgcttactcattctggcatgtggactgtgtccgtaaaaccggcttgaaagcttttacagtgcgctatgaagctttctgcaggaaacaccattatatttatcagccttccaaaccagaagaactgtttaacgcctctaaagagcttgttgccgtgttcccaaaggagacgtcctataagcttctgatccagcagagtatccagcagctcaatcttgcctctgcccatatcgaacagctccgcagggagatgaatgcacttgcttccacgctcccagaatacgaggttgtcatgggcatgtatggcgtgggcaaaacttacggtccccagctcattgctgagattggcgatgtttcaagatttacccatcgggaggcaatcactgcttttgcaggtgtcgatcccggtgtggagcagtcagggcagcacaactcaaagagcaacaaagcttccaaatgtggaaccggcaggctccgtaagaccctgttccaggtcatgaccaccctgctccagaatgccccggagaatgaacctgtctaccagtttctgaaccggaagcgttccgaaggaaaaccttactatgtgtacatgactgctggtgcgaataagttcctccgcatctactacggcaaggtaaaagcacatctgcgcagtctggaacaaaacgaataatcattccgtctattacggctttctttttgaccggctgatgaggcggtcttagagttgtgccataaaatcacttcacaaaaattttcaaaaagtgcttgactttttattagcaggctttctttgttggctttattctatctgaattaccgtgttgctaccaccaactatcaagcaattatcagttgcatatcggttgcacaatgatagcgttctgttttttgaccttattatactaaattaccgtagataaggatagctcgactgataaaacttgctggacgggaacagcttgcagcgcaaggtgtttccgggcggcaagtccacaaaagggtagctggcgacagccagcgcaggggaagcgtagcgtcccctgtatgatttggagcagaccatgactgcggaaaatcacagccctccggcgaggagccttcggagaacgcaatgcaccaacctttgggtggtgtataattgcgcccttagtaaactaagggggttccggcatctcccgttccagcagttttttcaatagttcctgcgtgtcctgtctgtgaaaaatgagtttcaacaacagcatgacatcatcatctgtcaggcgttccggttcttgcagaaaactttccagcataccgccacgtgtacagagccggtgcgttcgttcttttcgggtaagctgcttcagctgatgctgcaatgccttttcatcattgatggctttccgcagtttcttttcgcttttttccaactcccgattgagtttttccagctttgatgtatcaggcaagggcagcgtcctcctttcccggtatcagcacataaatcctgtttggttctccaatgccctgacgcacccgcatgataagtccggcagtttccagttcattcagagaacgcttgaccgtcatggagctgcgggacaggactgcggcaatggctgtgacagggaagcagacaaagaggattccgttctcgtcctcctgccctttggagagcatagcgtccagcatccggcagtacatgacctttgcggtgctgctgactggaaatcctgtcaacgctctgggaaaaggcatacagggcggcaatggtgtgtctatcgtcataaattcaaaattcattctgtgtgttcctcctttttctttgctcgtttggataaataacaggggcagtcaatcacaaccgcccggaagctctgcttgcacccatgctggcatttccggcataattcgttgtaagtgacacgcccccggtcattgaggtaaaaggaaagctcatacttcctctttttgctcattctcggcatattgcgcttcctcccgttttagtgtatggtttcggggcgattttcggtaaaattacagccatagagccgcttaaaatctcccgaagtatcagcgatagggtagactgtccccctatcagattgttgtgtttcggtatcatttcggtgtcagttcgccagttctccccggtgtcgttcctcccctgaatctcacagcggcgtatcgctccctttggtacgctcgttttggtcagggttcctccatatccctgccaaaagtcatgacgctacatcgccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgttagaaagggggaactgcttcaatgaacggagctactacaatacaggaacggctaaaagatttacgattaaacaaaggattaaaactggaagaactggctgagcaaacgggtatttcaaaatcggctcttggcagttatgaaaaagacgactataaggaaatcaatcatggcaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctgtgcgaacttgccacccataaggactttatcaagtttcttgcggacattgagatttatgtggatgggattgccaccatgcagattcaaaacctcaacgcccttgtcgataccgtccggcatgaaatcattgaacggtatcgccccggcgaagatgacccccatttgaaagtgttgcaagccgcccatatcagtgatgatgaatatttcagtcacatggtacgggatgacctcaacctgattatccgggatattcgggaagcccataaaaaggacagcgagagtgcacctcagaccaccgttgccgatgaactgaaagaaaatctggaagcggttgaaaatttcaagggcagccgtgatgaaaagctggttgtcctttactgtaagcagcttggtatcaactataaaaatctgtcagatgaagaatttcgctggctgattcggattctcaaaaaatcaaagaaaatgggaacgcctatcagccagaggaaaaaacgataaagaaaaaccgctgttgcatggtttgttggcttccatgtagcagcggtttttgctgggattattcagttgaatttttagcacgacaaactggaatttgtcaaagaggattattccaatattccacagtatttctatttacatcataaaaagtaatattacccgcatttataggcaagacaatcgcaaaaggtttattgcggtcaatatcaaccacttgaattgtgttgccatcatctatttcaagttgttgcacctgctgttgattcatagaaataaatgctcgttcattatatccctctacagtaaactccacaattcctctttgaatccccgaaagagttccacctccacggaaaaaatatccgaaggaaagtcctggacgattgacatagacggaaaaagaatggtcactcaaatcctgagggtaagaaatatatgcagccatcgtgctggaaacgcttccatcgaccgtccaatcatccttaatcttctgcgacgaacgaatatctgcctccagcttagatgaagtcacgccgatctcattgttcgtataaagaaaacaaacaaataaaatacaagcaagaacaacccctatcacaattttaagaaatatttttttcgatattatttttcatttttttaaactatttaatactaatgtcttttataatagcttttcatatattatataatcaatctttataagtccttttataaatttcttttctaccattttcgataaattcctgtttaatatttttaattccataaacaatagtttcaataggataatattcttcaactatatcttgatattcttttgctttctcaatatctatatttccatacattcttaatatatcttctccaaaatttgttcctatttcttcttcactatcttcaagtaagtatataaaatcacaatattcatctataattccagaatctccaaaatcaattattccagttaatctattattgccatctaacaatagatgattacaactaaaatcattatggcataaacactttttaccctcaaaaactgttgttgcatttagtctttccataaaactttctatataatctttttctatatcagttaaatcattataaatagtttcacgcaacaatatatactcttctaatacattttgtttattatcaatagtacattcactaatatctgtataatctaaaccgtgcatttgtcttaaaaaactggcaatatctcgttttaacaaattttgttcttcttctgacatagtagaataaatttctggtgttaaaaaagttcctttaatttctttataacctagtatagataattcatcactaatatacgaatattcaatattaggaatttttacattagtttctaaatttgtatttaaaaaattatatattgctttttcttttgcataaccttttttcttattagtactaaattttgttttaaaaatgtattcattattaactaaatatgccacactatcataaccactaccgattatttcaatactatctactttgaaattatcaaagtaatgctcaattaaatatttcattgccttaacatttgtggcattatcatcatatctatattccattaaataacaatcttcttttttgccctcgtgtaattcatgttctggcaaatcttcaataattctaaaaccagatttttggtatgcccttattgctcttggattatttttatgagggtctaaaataactgcattagcatttctttcttttttcaaaaattcaaaaatcaatttaatatatcttgtaccaattcctttactccaataatttggctctcctataaattgatccataccatagactatctcatcagtttttggataatgataatcagtatataactcatcatacattttatatatttgtccatatccaataggaacattgttatattcaataattactctaaaaacttcatcttcccaaggctctgtataatgtttttttaatgattctaatgtatattttttatctctaccaccataaaattctaatactctttcatcagttaaccattttaacatcaaaggaaaatcatcatctattaaagttcttatacatatttcattttcaactatattcatttatttatcacctttttcataatcatatacatatactatttcatctttataatcatttttaccacctaatttttcatatacatggcaagctctaggattacctttatcagttattaaaaacatttcagaacaaccaatctctttagaatattccttaataaaagataataattttgaaccataacctttgtcttgatagttaggtaacattcctattgagtgtaaataaaacattgtttttccatcaggtcttaaaagtgtatagcaatatgcaaatcctataattttattattttctttagctataaacccaaatgaactggtatcattaagaaatccttttaaattatcaatatcaaaaaccatattatcatcaattaaaacttcttccataaactttttttcacgctatcaaaactccttgtcaactttcgatttgtcataatcattctaccataccgttatgaataaatcaactcttgcaaaataatttcttctgcccggttgtgaatgttattgcaacgctgcacccattccatttgatgggtacgcttcaattcctcggtcacaccatcggcagccttcatctgctccatgatggtgtctaaccgttcctgtgcctgttcgttcaggtctgcaagatatgtccataactccccggtcagtgtcaatgtgttcaatctggctgggtgggcttctcttaaatattcccggtgcatccgtccgtactttccgatagggcggtgttcctccggcagcttcaaatctgggatatagtaatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggccaatgtatccatgctgatgtgctttccctctttgctcatgttggcaatcatattcgttgtcataccggcggcaagccttaaatcttcttttctcatatcacgctctaacagtgtatgccagagtggtttatagctgatgtgcatattgttttcctgcctttttatccataccaccggggcggctgccccggcaggaacttttctcttattataacaccaatcttgtgtaatcacaatttattcttgtatcctgccgctgataccgtctggattgtgcttttcctttctttttgttccctttaattagccataaactgcttcatgccctggctcttggcgccggggttgtcgttgccgtaaccttccagcaggttgataacgccccagataccgagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccgcccgatttccggggggcatgattccggctgtcctcctttttcattattttttcttgcgattgtccgctttgtacgccaatggcccatagagggcaggtgcggcgaatagataagatcactcccttctaaagcggaacgaaattaagcgccctttgtgtctacttcatatacatcgcagacctcattgggcttgagtttcagccttgcggacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgcctccatccataacagcaagctcatcctggctcatcagctctttccccaatttttgatagttgagtgaatgggaggtttcccgtccacggctctctccggtattgtaggtgtcgatggtttccttgcccagcacggcagccagctctttgagggtagtcggctctttaccgcccaggaagatggatgtatccatgttaccgatgatggtatctgcgttatccttatagatcgccttgagctgactctgtgcctgcaacaccagacaggcagagatttcacggcttcggatggtggccaccagcttttccagtttcggaatctgcccgatgttagcacactcatcaatcaaacagcgcacatgaaccggaagcctgccgccatacacatcatcggccttttcacaaagcaggttgaataactgggtgtagcacatggaaatgagaaagttaaaactgtcatccgtatcactcataatgaggaacagggccgtttttctgtctcccagcgtatccagttccaactcatcgtaggatgtaacctcgcgtagctccgcaatatcaaatacggccagacgcgcaccgcaggaaatcaaaatcgacttagcggttttgccggctgccagcttatatttcttatactgccgcactgcgaagtggtttggcttttccgattccagtgcatcaaacatcaggtctaccgggtttttgaactcctcgtcatcctcccgaacctccatggcgttgatgaactcgatgagggtagagaaattctgctcctctaccggagcctcatagtggatatacccaatcagcgcgcaatacagcaaggtctctgctttgacccaaaaatcgtccccggccttgccttcgcctttggtattggcgatcagcgttgtgaccagcttcaagatgtccttttcgctatggatataggcgaaagggttatagtgcattgattttcggaagttgatggtatttagaaccttgatgcggtacggctcataaatgaccttgccgtgcttatccttcatgggctttccgtcctttcccagtttgggtgcgcccctttggagcattttcccgcactccaccaaaatggttcccttcgggtctgtgaccacataagaactgtgcatctgcatcagatttggtttgagccagaaacgggtcttaccggaaccggagccgccgatcaccagcacatttttgtttctggcggtctttgggtccttggggcggctgttcatggtcaggctttcggtttttgtgagaatgacattgttctggaacaccgggtcgatgtagggagcaatatcctcacgggttccccaacgggcagaaccatactccatgccgtgacggtacttcttggcgtttttacttttgagatacaccgccagacgcaggccagcaccgcagcacagccccaccagcagatccagcgggtgcaggctgggccagaagctttgcagcgccccaggcaggacagcaaacagagaaaggaatttctctgaagcatttgccccctgagccagtcgccatgcctccccgaagttggtagtaaacagccccatcaggagatagggcaggttcagcaaaacgagctttttgatgtcaaactgctttttcatcgttccagctcctttcgcttggtgcggtccaccacggcatttttgaccatctctttgaactgactgagttttgccagcacagacgggcgttctgttttctcggccttcttgacctttttgctggtgtactcggtaaatgcagcggtcagcgcatcggcgtcacggcctttgaaaaagatcaggtacttgggtggggagctactgcggtctttcttcaccgcatagtccacaccatatttccgggcgatcttctcaaattccttgatggaagggtctgtgatctcgatattggagatcccctgattctgaccaatgagctgcttgacggtctgttttccgtggggtgtcacaggagcgtcacggcttctttgcttttgcagcttcttttccttgcagtgggccatgtacttgctgatggcggctttgagcagcctgccggtgaactttgttccactgacaaccagcgttaaagttctgttttccacttcttcctgcattttcatcgcctcctttccacaaaatgtgcaggggtggtgcattttcttctaaggcgggaccaccagccgccggagaaaatatttcttcatcgctccatcccgcggctctttttctttaccggcttcttatccggcaaattccactcttcccgaaactctgccacacctttgggatcaaataccttcaacttctccagatcaaaggcaacggcagaatattttccataaccggactgcacctgatagggaagcaccttccccaatttgttctctttgatgaatcgcagcaggtccttgctgatgtcaccggaaataaacgcctctccggggtccagggaatatcccggtaggttcaccgtcatatctgcaaacggttctgctccatcttctgtatgggtaatcatgccgatataaagccgctgattattcgcatacatcccaagttgcagcgatatggtttcttccccatattcccacttgaaggggactttcttttcctcattcatatcagattcctcctatcgtatctgttctttgtggtcataaaacaaatctccatttctgacctttgcatggctgagaatcttgatctgcccctttgcctgactgtccagagctttttcatagcctatatctgacaaaaacaggcgggttcgttctcctttccagcccaccggggagtcattcgtcagcacatcaaaaataatcatgtgccgggtgttctccgcaaatcgctgaagatccatgtagtcatggccgtgatagttctgcgccccggctttctgacgcatttcctccatcagctgaccgattgtttttccttcctgcataaaacccacttcctttctgttcttataagaccagcaagatcatctcccgcagctgagcaaaatagagcttgccctggggcgtgaccagcgtgtaggaaccggtatgaccgtggttgcagtagtctttgacgcaaaacagccctgcatttttcacattggcataaggcagcacattgccggatgccgtgcggtacacaaaccgccgttctatcagaaaccgaacaaaccggcgctccgggacatccaactctttggcggtagtcctgagattggtgctgtgctttaagtcgatgaacaggtcatagaaagcggctttgccctccagctgtgcattttccttacgcagagaaatattcgcttcacgctcagccaacaagtctgagcagagcttcatcagagcctccggggaagtggcaacctcccacagcttctcttttgtgagataggccccgtgcttacgaatagtaggcaggacctcatcgaatacccaccgttcaaaccgctctgccgatggcaatttgctgtgaacgatcaggcggtacaaatcgccttctgggataaaagtcatactgattttgcggtcggggctttgtgggtgaggtgcgtcgcgtttcacgacatacctacaatggcggataattgcatcgcggggattactgtaccccagcgcagcagccacatccgttccgctgaacaagtatttgccgttttcctcaatgacacggatactgccaaactccgggtttttgaaaatttccatctggttcatgtcgtgcctcctttggcatgataaaaggcggcctttaccagccgcctgcgtgcatatcgtgattgaccagtgaagtgtagtggttattcatggtggtaggcgcattgaacagcaccgcaagcaggtactgcttcatgttgcgtacctgggtggtattcttttgcagacagtccatgacaaactcgatgtgggagctgtccagtttcaaaaaacgggaacgcacgatctcgtgagggaagtctgccccagagatccgggtggtctttcgtttggcacagaccgtttcgaccaacagctctacgatctcattcaggtcatccaggtagagaggataacgctgcttcaagcagtcatactcgatattctccaaaatcaactcccgataattttctatctctgtgacagacatcgcatcccttcctttccgttccggcggtcttgccgccgctgtttcccggaagggaatggaatcggtacttgatccataagtaattgatttttctgtatttgatttctctatatttaattctgcgggcttttccatatccggtcttaccatatccgggttttccgtatctggtgaagccgtatccggctgggacatatctggctggggctgttcatagatgacatactcggtatctgtaatccgcccacttttatcgcgtctctgatggcgcacgatatatccggctccttccagttcacgcagggcagcaccgatggcatccacgccttccttacagatctttgcaaggccacgggtagtgtaattccagtcctctggcaaagacagcatcatggaaagcagccccttggcttttaacgacagatttgcatttcgtaaatgatgattgctcatcacggtataatcacgggtccgttcaatgcgaaaaacggccatcgacctcactccttccgaattttgggtacaaaaaaaccgcaatcctcatttcaaagaattgcggtgttcagcgcttttcaaattttcttgcatagaaccaaaacagcggcttttggggacgcgcctctgtaaatggctcctcctgggcgaaaggaagtgtttgcatcacgcggtcaatatccgttgaatccatgtcatgctgagatttgcaatcttcccggattgcttcttgaatttcctttaccgtacacatagtcattcctttcctttcgttgtatgggtttatgagcggcggcgttttcccggtttgaaatcgaggatatgtccctcaatcacacgagcgtaacgcttgattttgatctcccggcgctgttgactttgcagggcggcctgatacccgtcctcagtcaaaaacaaccgcatttcatctccggggctgccgtaagcagtgctgggacgcaggacggaaaactcgatcatccagcgggtattatcccaaaacctctctacggcgagaatgttgtgtcctttcagctcacgggctgaaatatccctcataggcggctcctttcatcgttcctggtctctctgacgctttttctgccatgcctccagcagcttgataatggtttcctgcatccgctggggcgtatagcttttggggaaatatttccgcaaagtgtcggaggtaaatgtcactcggtccagatcacttttcttttcctcacccatgatgacacgcatcatatcgagggtcagatgcccctcctggctgtatttcttgagccgctgggcttgggaaagggaaggggtagcctgttcactgtccatcgcgtccagtaggtctatctgttcttcctttttgagaaaggacagctcataagcagggttcagggcaatcttcttttcatccaccatatccatcaattcaggaatcagctctgtcagacggataaatctcttaatctgtgatttgctatctggactgttctccgcgattttttctgccgcagtcaacttcggcccaacttgggccgaagttaaatccgtcctggctccttggtgcttaatggcatccagcttcattttataagcaaatgctctttcactggggagcaggctttctcgttgtaaattgctgtcaaccataatgattgtagcggcatcatcatccaaatcccgaacaatgaccggcatggtctccttttctgccagttcactggctctgtgccgcctgtgtccggctaccagctcataaccgccctccgggtccggtcgggcaatggccggaaccagaacgccatactgcttgatactgtcagcagtctccatcatggcttcgtcatccctgactttgaatgggtggttcttaaacggatgcagttcagacaacggaatttcctgaatcttttccagctttgcatcctggcggccttcttcggtggagaacagatcatctaccgatgccagctctatttttttcgcgctgcttttcaagtttcaacacctccttcgtcagatttttgtagccctctgccaccttgccgccgggatcatgggcaaaaatgctttttccctcggcgctgatttcctttgcccggacagaatggggaatctctgtgccgaatactttgatcttgctgccataggtctctcgcaaaagtgcggaaatctctttggcaaagttggttcggctgtcaaccatcgtcagcaggataccgtctatctggagcttggggttgatctgccgctttaccttgtttaccgtggagagcagctgttccagccctttggcgggcagatactccgcctgaacgggaattatgatcctgtttgcagcggccagcgcattgactgtgagcatccccagggagggctggcagtcgatgaggatatgggagtattgccccttcagcgtgtccagatattgccgcaagatagtctcacgactcatggcatttaccagggatacttccataccggataactggatgtccgcaggcatcaggtctacaccctctgggtggtgcaggataccctcgccgggacgaagcggctcatccatcaggatacgccccatagcgtccgacagcgtaaagggcagcttgtccggttgtggattgcccaggctgatagtcaggcttccttgcgggtctccgtcgatcagcagaactttctttccggcctgcgccaaaccgattccaagattggcacaggtggtggttttgccaacgccgcccttctggttggcaatggcaatgatttgcgtgttcattgacttcacctcatttctaattgtttctgttgcttctggaaatagaaaaagccgccactccaaaataaaaagtgaagtgacggctctttctatcgccggaatacgagttcctgaaatgaaaaaagcacccagtcattttatactgagtgctgtatcaaattcatattcaattattcaaattaggtcaaactatgccaaactgccacagccaaaaacgaggggaaagagggctgaaaagtagcccccaaaacacccacaaaatcggctctcggttaaccactttgggcaccacttgaccctctttttgccctctttttggccggttaaccacttgcggaccactaaaaattgggtgaaaacggctctcgttttgctaaatttggtcaaactatatcagcccgtttagatacagtaaaaccccggaaaaccttgattttccggggtttttgaaccattttgatacggtttgaacagcagattatctcttgctgaactgaggcgcgcgacgtgcagccttgagaccgtatttctttctttctttcattcttggatcacgtgttaaataacccgctttcttaagaactggtctgtaatcagcgtcagcctgaagaagagctcttgaaaggccgtggcggattgcgcctgcctgtcctgtaaatccgcctccgcgtactgttactaatacgtcgaatttatcggctgtctctgtagcaacgagcggctgacgaacaactaccttaagtgtctcaagaccaaagtagttatcgatgtctctcttattgattgtaatgttacctgtacccggtacaatatatactctggcgatagatttttttcttctgcctgttccgtaaaatttagcgttagccattattgtttcctccttccagcacctttaattaaaatttgatttctaaaacttccggtttctgagctgcctgctcatgctctggaccagcataaacatgaagttttgtaagcatacttcttcctaaaggtccttttggaagcattcccttaactgctaactcaataactttctcaggctttttagccatcatctcttttaatgtagtctctctcataccgcctacatagtcagagtgattgtagtagatcttctgatctaactttttgcctgttactttaatattttctgcatttaccacgatcacgtaatcaccgcaatccatgtgaggtgtaaagatcggtttgttctttcctcttaaaacctttgctacttctgatgccagacgacctaatgtatatcctgtagcgtcaactacgtaccattttctctcgattgttgctggactagccataaaactcttcattggttgacctcctgttttactatcagatatttgagattaactttatcatgaaatgtctgttccggggcattggtacagacgctttctcctgatgtcacagttatacattatattacactctgccggacgtgtcaaccactttttccttataaaataaggttttctgcgacatttcaagttttatccatccgccaaaccgcattttccctgcagcacgtcttcccggataatatggcacatctttttcggctcttcaaagcagggactgtgagccgaattttcaaaggtataaaaacctttcaccggcgcttttaccgtgtctgcaaactcttttgcaaggctgtaggatacctggtaatcaaaccggccctgaaaaatgtagaccggaatctccagatggggaacctgttttacaaaatcggtctgtatcacaaagtcccacagacatttgagcgccagaccgcttcccatgacgaagtgaagcttatctttcaaagtgtaccctttatagcgcagcactattttaatacaatcactcatggagtccagatgatgcataatcccgatcccgagtttcatcatccccacgctccgcaccgcgagatactgaaagcttacctcgcctcctctgtcgattgggaacttctctaatctgcgcagcatcttcctgtcgcctgcggcagtaaactcatttaccataaaggaataggcaagacactcggattttgactggcaaacaacctgaccaattccgatatagccatggaacagttccggtgatttctgaaccgtaagcactcccagcacggaaccccaggaatgacctaaaacatatattttttccttcccgaacctccggcgcagataattcgtcaccgctgtcgcatcctctatcatctgcccgattgtcatggtttcttttgtaaccttccggctgtaggagataccgctgccccgctgttcccaccagcagacagtaaataactgttccagccccgtcgggtaatcctgagtgaatgctatctccggtgacccgggtcctccatggaggtacagcaggaccggattttcggtgttttcactctgcaaaaacatcccctgcctgattccgtttacttcaatgaatatcttttcatctaactgcctgttcatcatacctgctttcctgcctgtgtccatacgcctttctttctcctacactctacctgcggcagcagatcctgtcaagctttttacagagaaaaggagagcttcctccccggaacatctctccttttcccgccgcttgttttgtaatgaactttttttccttatatgatttaataaatttaataaggccgtatttatttttgtttcttcgcctccaggaaatcattcaactccgtattcaggacatttgtgataaacatatgtcccggagcatgggtaattacaaggggcagcttcgcattctcgattgccgcctgcggagtaacgccgcaagcccagaatacgggaatctctccctcgcggatttcaacgctgtcgccgtaatcaggcttgttgatatccatgattccgatcgcctcaggattgcctatctgcaccgggcctccgtggacattcgggtacttatcggtgatttctttggccttctctgcattctcaggtgtcatcggacgcatgctgactaccatcggtccttcaaatacccctgcgctctcacaggcgatgttcgtcttgtacatgggcacattgcagcccatcgcaatatggcgcacttcaattccggccctcatgagcgcttcctcaaaggagaagctgcagccaatcaggaacccggtaaaatcatcctcccagtaggaagatgcatcggtcacctcttccgtcctgactccgtctctgtagatgaaatatcttgggatgtccgttacgatattagagccttctcccatatcatgaacatccggagttccttccaccacttccaggatcggacatggtttcggattctttctggcaaattctttaaaatcttcagcatattttttcggcagaataaccaggttggcctgtgcgtatcccgcgcacattcctgccgtcgggtaatcaatttctccggaacgtatcagtttccagatctcttccggtgacgtcttgctgtagtctttcatgggtatctacctccctgtttgattttaaataggtgtccctagcgcagccctgttctctcttcctgaagctcgacaataaattcctctccgtcaatccgaaccttatacgttccggcgcttccccagtacttggacgcctcgtgggcgaccgccgcctggataaccgcatcccgctcagcggcaggctccggcgcttttgataacttctcttttaatgccttgaattcttccacctgtgcgatgtataattcctgtgcctcctcgatggaaaccttacggaattttaccttatatcccggcctggactgggccaccttgggaagatccacggaaataacgcttgcaatctttgtataaccacctgttgtctggtggtctgccatcataatgattggctgtccgtgagacggaacctggattgctccaaaagcgattccatcggtaataatatcgccgccgtttttatgctcaatcacttcgccctcgcaccggcagcccatacggtccgactcattggtgaacgcatacgttgcgctcaggaatgtgtcgagccccttctctgtaaaataatcatcctggggacccattaccacccgcagaacctgttccgtggcggtaaagtcatcgggtttaatttttctcaggtgcatattgggaagagtggttttcggcgccgtaaaggcaatctcatctcctgcccccagttttcttccttcatacccgcctaccctggatttcaggtttgtggacttgcttcccatgatgaccgggatatccagccctcctgcaaatgccacataggccctgctgccgctgaacatgccggcaaagcttaaggaatcgcccttgtgcacctgtaccgcctggtacatcggcagttccttgccgtttaacttcgccccgagattggcccctgtgacggcaatgatattgtctgctgtaaactccgccatcggccccatcagggtaacctccatgacgccttcattttcatcattcccgacaaggatgttggccagtgccgcagagcgctgatccatgacgccggatacggacatgccggactcctgatagcctgtgcgtcccatgtcctggattgtcgtgaggaaccccccatttaaaaatttaatgcccatcgttacacctccttgtcatatacaacgtaacggtagctgccgtcttccacagccttcagaattgcgtcgtattcttccggggtaacggacttaaactttatgtactgtccggcttccagaagcaccggtttctcacgctctgcatcataaagctttaacggtgttcttccgattaactgccagcctccgggggagtcaaccgggtagacaccggtctgctcgccggcaattcccaccgaaccgccgtcgattttaaccctggggctttttaacctcggggtggcaatctctttgctcattcctcccagatacgggaaaccggctataaagccaatcatataaatcagatattcttccgatgtgtgaatctgaataacctcttctaccgtcttaccgttatgttcggccacgttctggatatcaggtcccatctccccgccataaagaaccggaatttcaattaccgttggcggcgggatttcgatattatcaagggaacccataagctcttcgaacttttccgagatttccctgaaactgataatctcaggtttataatagacaagcagagaacggtacgttggaacggtctcgactatcccttcgattccgcttttttcaacggcgattttaaacgccctgattttcttattgatttcaggactgatttcattgccgaattcaacacacacggagcagtcgcctgatacaaggtatcttacttcgctcatattttttcctccaaaacggtaacaagccgctgtacaggcttgttaccactaatttactgtcaattcattatccaaagatggtcagaatcttcggaagcgccatgatacctgaatatcctgtcagaaggacaacgccaagtcccagaacaatcagaaccatcgggtgcttataattttctcccacaatatcttttctcctgctggccagaaggatggtcagaagagtcagaggaagaatcaggccgtttacggaacctgccagtaccagcagagttgcaggctggcctaataaagtcataattacggtagaaacggcaataaatccgataacgaaccatttttcattttccatgataaatggatgcagtgtctttaagaaggaaacggaagtataagccgcaccgataatagacgtacatgccgcaaagaaaataacaaggccgaaaatcttatagccgatcacgcctgcgcctgcctggaatgctgctgcgggaggactggctacccatgcatcgcttcccacaacttgcggcatagccgtaacaacgcccagaacagcaaggaataataagattctcatggtgcctgacacagtaattcccataagaacggatctgcgcacttccggaagatccttggtccctgaaaagcctgcgtcgagaagacggtgggcgccggagaaagtaatatatccgccgcagcttccgccgagcagtgtaatcatcgggaataccagtcccggagcttctgaaaacttgaagacgcttgtcactgcctcgccaaccgggggctttgatttgaatgccacaaagagtaccacaagaatcataatgcttcccagatactttgtcatcttatccataccggatttggcatccttggacaggaaaatcaggatgccgatggctccgccgataatcgtgccggccttgaccggaagtccgaacattacgttcagtcccgtggcggctccgcccacgtttccaatattaaataccaggccgccgagggcaaccaggaacgcgataaaataaccgagtcccggcagaaccttgttggcaatatcctggccgcgcataccggacacaccgataatcgaccagatgtttaactgcgtcgtgacatccagaaggatggtgcagatgataaccattgcaaaaattgaaccgtactggcctgtaaaagtggctgtctgtgtcagaaagccgggtccgatagccgatgtcgccatcaggaacgctgctcccaaaaggaccgtcatattattctttttcttctctcccatatatatctccttcattgtgaatactgtctaaggttttcccattcccattaaaacagatttttaatacttacaccctccgcgatcagagtttcgcggatattttttacaaactcaagagcttttggattgtcaccgtgaacacagatggaatcagccttgatattaatgtcgtttccgttaatgctctccacttttccttcttttaccattctgactacgcgtttaatagccaggtctttatccttgataaccgaaccttccagtttcctggataccagagttccgtcgtcattatatgccctgtctgcaaatacctcgctggctgccttaaggccggccgcttcggctgcttcaatcatctttgagcctgccagtcccatgaaaatgatatccttatctacttcataaaccgcctcgcacattgccttcgccagcttttcatcgactgccgccatattatagagagccccgtgcggttttacatgctgaattttcacaccgtggctgtctgtaaatgcttttaaagcccccagctgatacttcacatacgcctttgcttcctccggagtaactaccatattccttcttccgaatcccatcaaatcaggaaatccgggatgtgcgcctacggcaacaccgttatccttcgcaacggcaaccgtcttttccattacaatcggatcgcctgcgtgccagccgcatgcaacgtttgcggatgatacatacttgagaatttccgcatccataccgatcgtataattgccgaagctctctcccaaatcactgttcaaatccacataatacatagtcttttcctccttaccttcactgtttatttgcccctcgaaccatatgtagttctgacagtactattttatctgactttaatatttttttcaatatttatttcgattatttttatttttatggctaattaacgcaaaaatcgtgcaaaaacgcacgatttttgcgtgcgtttttgcacgatgtgactttttgcacggtttatggttcaccgctctttattcctccctctccatcttcctcttgatagaaaaacgggtcgttcccaggagagcggcggctttggtcagattattattactgattttgagcgcctgattcatatataatttttccagcactaaaacctcctgttcgagactgattggacctttctccaaatctttcagataataacagttcccatgtccgccggtctccgttttctcaaccggcgtcagttctacgtgcttctccaggacattcccctggctgaacaggaagcagcgttcaaagatattcttaagctcccggacgttccccttccagtcatataaaatcagctccctcataaaatccggctctaccctctcaatgtttttggcaaaggatttattatagtagtccagatagtaatcacaaagtgcagggatatcttcccgccgctcccggagcggaggaattacaatctgcatcacattgaggcggtagaacaaatcctcacggaactggccctgcgcaatcgccctctccagattccggttggtcgcggcaatcacccgtacatccagctcgatatcttccagaccgccgattcgtttgtatttccggtcgtccagaaaagtcaaaagctttgtctgcatggcaagaggcagttctccgatttcatccaggaagacggttccgccgttagccagctctatcagccctttcttcgtcttcagcgctcccgcaaatgcgcccttctcgtaaccgaacagctcactttccaggagattttcagggattgccccgcagttgattctgaccatcagattttctctcctgtcactgcagtcatgaatctgtctggccaccacctcttttccggtccccgtttcccccctgatcaggacattgacagaggaattttcacccagcaccttgatctgggaacggatctggcagacagcctcactgattccggtaaaatcctgggattttcccttcaaaaattccagagaatcacggcgcttcatctgctccagacatctttttataataaaatcgatttcatccacatcaaacggtttcagaacataatcgtaggcccctcttttggtcgcctccactgcctgggatacggagccgtaggccgtcatcaaaatgacctggatatcctcatccatatttttgaaggtggcaatctcatccatacccacgctatgctccagaagattatccaggatcacgacattcgggtggaatttctttacacactctacggcctcctctatggtcccggccgatttggcgtcatatcccctgtccttcagcccttcctccagtgtgtaacggatcagaaattcatcatccacgactaatattttcttcataatcttccaccctcctgtaaaatgtcagccttacgcaggtcccctccccgcaggcactggccatctccatcaggccgccgttttgttccaccagcttctttacaatagcaagaccaattccaattccgttaatgctctttgtgtagaacggctccatggcgcgcgtcagttcttcccgcgacattccttttccgttgtcctgaaactcaatcagagccttgttcccgctctctcttcccgatatcctgattctcccctcaatgccgggaataaccgatttaatgctgttgctgatcaggttgtgggcaatctggcggaattcattctcattcagatagcccgtcagtccttcctccaccgcggtttccatcacgactccctgtccctccgcccccttggaataaatcatcgcaatctcaccaatgactttttcaaaggatatcaattcctttggggattccttctttacggaaagagtaaaaagattcataatcagagtggtcactctgtcaacctctttaatcatgctctcgcatagcattttgtcactttctttggctgctcttccctttaaaagctgtatccctgaacgtatccctgcaatcgggttttttatctcatgggcaagcgtcgccgacattttgctggtatactccatcttagtgtagttatccatgttacgtagcaggctctcaaatgtaacagccagctggcctatttcgtcttttcttttcaccgattcgaaccggtagctcctgtagtttcccttatttttgtttatttcccggcacgtactactcatactgcggattggccttgtaatgttatgggaaataaaaatactggcctgtatgatgataagaagggatgcgatggccccgatgacgacataattctgtttttccagaatttcttcctcaaacaaattttcgtctatcagaaattccagtttccatcccagcttgttcgcgccctcattcgttaaaaataccgtcttatcctgaacagagccgtcttcataagtaataacctgaccgtccttatccgtaatccggacatagcctctcccataatacctgtatttatctttcagctccttctcgctcagacggccggacaaatactcaacatccctgtttatttcctcaaacatgtagacggccagggttttctggttatctctctgcatcgtgtaaccgttgtaataggagattaccccaaaaccacagattacgacaattccgacaaataaaaacgggaccaggatttcgttctctatctgaaaaaaccattttgacagcctgtcggtcaactttttcattcttcagcccccttttccccttcagcgtaacagttccgacaaggaactgttactgcatccggctaataaaatcgctgcgcgatgagccggatgctcgcttccactaccttttcgcacggtccgcgcagcaaacgcgcagacctgtctgatctgttaccctttagcgcctgttttcctctggaaaaacggaattacaaggtatgccagaacagaacaggctgtggccgggaaggcccagtataccctggtggtcctgccccataacagagccgcacagattatgcccacgataaatgaaccgtaggccccggcctttgttcctctcggatataacagcgccccgtagattaaaggcgtaaaaatcactgcaaaaactccccatatatcggcgccgaaaaagaggatatcctcagggggattcagggacagtattagagccagggtacctccgatgaatataaaccacttggcgcgccccagcagcttgtcctccttcatcccattcttcccgaactgccccgccacatcataagacagcatggagcctatcagcaaaagctgcgaattggccgtagaaaggcacgctccgattacgctgatcagaaaaaaaccgctgaatctgctttgaagcagatagtttaccgcataaacaaaaatatcatccgtatcatgaaaggtgtcaagacgcggaaaaagaattttaagccccagccctatctgagtaagggcaaaatagaacagagccagaaaaacaatcgcacacagcagcatttttctagccgtctttttatcttttgcggcgacaatccggatcatgtactggggatttgtcgccagtcccatgccccagccgaaaaacatggagatatacataagaggggaatagtcccggaacaagcccgggttctccaccgccactccggctttcagtgtttctctcgccacagtgctgtccgataaaagccatgtgccttccactttcccgactataacaaaataaatcacgcctacgctgagcgccagcatcaccagattacaggtatctgtcttgataaccgagttaaagccgccgaacgtggaatataatataaagagatagaccagaaaaaccgctaccttataatcaatattaagcagattggaggcggcaatgccaaatcctttaatctgcatgacaaggtaaagcacataaccgcatgacatcagcagggcggaggcaatctgaaggccccgggagccataacggttccgaatcagctgtggaatcgtaaggatatcgttgtcataaagccggttgctgattgcatacagcatcagcgccccgataaaccacggaattaccgacatggaaattacagccaccccgttctgatagacatttcccgtatacccgagaattgtggcggctgaaatccaggttcccacaaaagtaaaaaaaaggcggcaaagcccgatttttctctctccgacaaagaatttggagatagaatcactctccccgaaggaagactttccaataaataaaattgccagcgaatatacgccaaaataaaccagatacacaaatgttttactcatttttcccccgtttttccgacgaaattctattccggtccggcatcctccatttggaatccggtcccattcttcacaactttataaaatccataacggtctccggcccggaacctgtctttttccgcgtccgtcacgataacgctcccggctccattccggtaagcctgatgtacgacacgtttcacaagcctctcaaactcttcctccccgcagcggtaaaccgtcagccgggcggggcctccgtctcctgcctccctctgatccagtacgtaatgccagtgcctgttctgcccctccaaaaacggacgaagctccttttcatattccaggcttacaagcgtaagaccgaccgccggtatggtcggccctgctgccgaccggtccctggcctccagtatctcttccatatgctccggaggatatacgccgagaccgaccttcacaagggttccggtaataatccgcaccatattatagagaaaaccgcttccgctgatccgaatcgtaatcatatccccatcctttgagacatcaaggctgtagatcgtcctgaccgtctcctctgcctgggtgcggaccgtgcaaaagcttttgaaatcatgttcgcccactaaaaaagccgctgcctgcttcatcttttccacgtccaggttgaaataacagaagtggctgtaaagtcgttccagcggcatgctgatttttctgttcagtatcttgtattcatacgtttttgtgcaattggcttttctcggatggaatgagagaggaacctcttccgatgcctggacacggatatcgtccggcaggcgctggtttaatgcaaagcaaatcttatcccccggtattctgctctccgtatcaaagacagccacattccccctcgcatgtacgccggagtcggtacggctggccccgattacggtaacaggctccttcagaagccctgttaaagccttgttgagcacttcctcgattgtcacgccattgggctgtatctgccagccgcagtaggccgtgccatcatatgccacagtcagttttatacgtttcattctattcttctcccggcatggttctacataataatgcggaccgcgataacagcagccagatagataataaatacggcataagccgccctgtccctcttctcatagtgcagaggcttcatcttcgttcttcccgcaccgcccctgtaacatctggcttccattgccatcgcaagatcggttgcacggcggaaggcggagacaaacagcggaacaagaagcggtatcatgctcttcgctctctgcatcaggttgcccgtctcaaagtcggctccccttgccatctgggccttcataatcttgtccgtctcctcaatcagaatcggaataaaacgcagcgcaatcgacatcatcattgagacctcatgaaccggcacatgaagcctgttcataaatccgaggctcttttccaggccgtccgtgagctggttcggcgtcgtcgtcagcgtcatgatcgatgagccaagcaccaggtacatcagacgcaggcccataaaaaaggccagactcaggccctcggccgtgattttcagaaatccgagccggaaaatctcccggccgtccgtcagaaacaggttaaagctgacgctgataagcagcaggaaaacaattgctttcagccccttcacaatgaatttgaaaggcaccttcgaaagtctgactaccagggtcaaaaacagtgtggcaatcaggtagcaccacagattatcggcaaaaaacagtgaaataatgtatatcatcgtaccaaacagcttcgttctcggatccaggcggtggatcggtgaatctaccggatagtactgtccgattgtaatatccctaatcataatgtgagcctccccttttcccgaaggaggttaagaatcgcatcccttgcctcttccacagtcgtaattgtatcatccacagggatcccatgctcccgcagctcctggaccacataggtaatctgaggcgccgccagtcccatgtcttccagttccttataatgtttaaatacttccttcggggtatcgtcaaagaccttctccccgtggttcataaccataatccggtcaacatagcgggccacatcctccatactgtgggagacaaggagaatggtaaggccgtaccggcggttcagccgctcaatctgatccaggatctcatcccggccctggggatccagaccggccgtaggctcatccagtatcatcatctcaggccgcatcgcaaggactcccgctatcgccacccttcttttctgcccgcccgacaattcaaatggcgactgttcatagaagctctcatccattcccaccagatccagggcatggcgcgccctcttctcggtctcttccttagaacagcccaggttcttcggtccaaagcagacatcggaaaatacatcagcttcaaaaagctgatgctccgggtactgaaatacaagaccgaccttgctgcgcagctccttcatcttataaccgtcgctgtatatgctggtcccgtgatacaggatatctccgcccgtaggccggatcaggccgttcagatgctggattaaagtagatttgccggaaccggtatggccgatcagaccgacaaattcaccgtcatttatctcaaaattcacatgcttaagggcatgctgctcaaaggcagtccccgccccatatgtgtaattcaaatctataaccttgattgacatatcttattcctcttttaagagcggaagcagcgcttccatcagctcttctttcctgagtattccatccggcagcatggctccgcccttttttaactcgtaggccagttccgtcacctggggaacgtccagacggtagctcttaagctcgtccacccttgaaaaaatctcttttggcgtcccatccataaccactttaccgccgtccataacgatcacgcggtctgcgtctatcacttcctccatgtaatgagtaatcaaaagtatggtgatcccctcagcccggttcagctcctgaacggttttgataacatccttgcggccgttcggatcgagcatggcggtcggttcatccagaacgatacactggggtttcatcgccatcacgccggcgatcgccaccctctgcttctgacctcccgacaaacggtttggggacttcttcctgtacgccgtcatcccaacagcctgaaggctcttatccacccgttcccaaatctcctcggtagggactgcgatattctccggcccgaaccccacatcctcctcaactacgttgccgataatctggttatccggattttggaacaccatcccggcagtctttctcacttcccacagcagatcgtcgtccgccgtatccatctcagatacccagaccgttccttccgtcggaattaaaatgccattgatatgctttgcaaatgtggactttccggagccattgtgtcccagtacggccacaaaactccccttctcaatctccacatccacatgatcaatcgcacggtttacttcttccactttatcttcttcgtcccgtctgatatagtcaaaaacgagatttgccgctttaattatattcatattcaagcccttcataaccgcagcttatcactgcatatttgtgtaaattgtagagcaattgtaccccggagtcaagtagtattttgtttctaaaaatcccatccaaaatatcggttcccggcagcggcagaaactgcggcagccgggcaataaaaaccggtccggcagataccggatcggtcttttaaaagggattatgtatttggggtaaatttcacctcctcctaatatataagtgtagggtttcagtacccaacagccagttgggacttaatcctctcattgtttaagctgtataatgattaggcattggtatgacgacacctcctaggaccactttaggtgtccgcaagaaagccagtcagccagcctatcatttgcagccgttcgatttatgcaggttggactgtccttgtacatgtccgtttgataccccaggagattgaataagcagtgaggaatgctggataccatgcaaattcattttcaggaggtacattaggatgtacaacgctgtcggtattgatgtctcaaagggcaagagcaccatcgcagtcctgcagcccggaggcgtcattgtcaggaaaccctttgatgtttttcacacttcccaatccttaaaagaactatcaaattatctggcttcacttgaaggggatacaaggattgtaatggagtgtactggcagataccatgagtccatggctaactccctctctaatgccgggttttttgtaactgtcgtcaatccgcatctgattaaaaactttggtaacaatacgttgcgcaaggtcaaatctgaccctgctgatgctaaaaagatagcacgctatacccttgacaactgggctgaactgcggcagtattcatgtatggacaatacacgtaaccaattgaaaaccttaaattcacaattcagcttctttatgaagcaaaaggttgccgcaaaggcaaacctgattgcactgttggataatacataccccggtgtaaataaactgttcaacagccctgcccgtgaagatggcagtgaaaaatgggtcgattacgcttactcattctggcatgtggactgtgtccgtaaaaccggcttgaaagcttttacagtgcgctatgaagctttctgcaggaaacaccattatatttatcagccttccaaaccagaagaactgtttaacgcctctaaagagcttgttgccgtgttcccaaaggagacgtcctataagcttctgatccagcagagtatccagcagctcaatcttgcctctgcccatatcgaacagctccgcagggagatgaatgcacttgcttccacgctcccagaatacgaggttgtcatgggcatgtatggcgtgggcaaaacttacggtccccagctcattgctgagattggcgatgtttcaagatttacccatcgggaggcaatcactgcttttgcaggtgtcgatcccggtgtggagcagtcagggcagcacaactcaaagagcaacaaagcttccaaatgtggaaccggcaggctccgtaagaccctgttccaggtcatgaccaccctgctccagaatgccccggagaatgaacctgtctaccagtttctgaaccggaagcgttccgaaggaaaaccttactatgtgtacatgactgctggtgcgaataagttcctccgcatctactacggcaaggtaaaagcacatctgcgcagtctggaacaaaacgaataatcattccgtctattacggctttctttttgaccggctgatgaggcggtcttagagttgtgccataaaatcacttcacaaaaattttcaaaaagtgcttgactttttattagcaggctttcatttaaaaagggccgtaattaatcaaggttgctatcgttaaaagaataaaggaaataatccaccacagcgcaaaacagggtaaaaaaaacttcagccacttcttataaggtatattgcacatggcaatgccggccatcagctttgctccagccggtgtaaccatatttgacagcgaatcaccgaactgaaaagccagtacattcacctggcggtttatccccaacaagtctcccagcggtatcattaacggcatcgtaaccgcagcttgtcccgagccggagggaattacgaaattgattacatcctggacggcaaacatagcacaggcggcaactgtacggggaaggccgtgaagcaggcttgccagggcattaattattgtatcaatgatgtttgcttccgtaaggatattcgtcactcctttacaaagccccataacaagaccaacccataaaagacttttcgttccttccacaaattcattgcatatctgatttccgttcaggccgccgaccactccggccgtcactgtcataatcataaacaccgctcccatttctgtaagataaaatcccctggtaagaatcccccacaccatcgatacgattccaagaatgaaagtcagcagcaccagcttgtgccgcatagtcataggcggaatatcggataaatcaagagctgtccggtactggctgtcaatttcatacatcaggcttttctccggatttttacggattttatttgcataggtgcaaagccatatcatgctgacaatttcaaatacaatgaaagcaaccgccctgtagccgattcccgaaaacatgggaagctcggcaatcgtctgggatacaccgaccgtatatgcattcgtcatgccgccgcagtacccgatggaggatgagccaagtaccaagaatgcagcaatcagagagtcaaatccaagtcccaggcaaaccatatatataagcggcataaatgccagaaattcctcactggtggcggcaaagcaggacaacaggccaaatgtcaggagaatggcaatcaaaagcagattttcttttcctgcaaattttttaattaaattttttaggcctatatcaatcgcccccgtcgcctgaataacctgcagcgccccgcctacaattaaaataaagaaaattaagttcccggagctggcaagcccattaggaaccgccatgaaaaaatcaaatatttttatcggattctgcgccacatgacggtaactgtccggatctactatcgaatagcctgttatctcattttcaaaacggtcaaatgagcctgccggcaccaaataagtcgcaattgccgcaattaccagaaatgcaaccagtatgagcatcggattaatagcttttacccgtttcggtacggttctcccctttttcttgtacatatcttccccttctttcaaaattatcaacagcctgctcctgcagcagagagcggaagcagaacggggccgccttagtcaaaaccggcagctccgtttactgatataaaacagcttacatataccccataagcatcatgattccgcgcatcccaagcattcccaccaggctgagaagaatcggcagccccaaaagatgcgacctgtatttcggatttgtccctgctacaagaacaattcttgcataatgtcctactaacgttcccatcagcatacagggtacaaccagaatcgttgcctgagccgcattaattgttccggccgcatataaattcgccgccgtagccgctcccgccgcttttgcaaaaaacgccgacattaacacaattgccgcctctcccggcaggccaaaaattcccattaccggagcaaatacctttccaatcagatttacgaggcccgtaagttcaaggaacctgattataacgtagcccaataccatagccggtaatatattttcaatcccgatatagaacccttccttagccccatccatgaaagaggtaactatcgactttttctgttttttctcttcctgattattatcagtgccggcctcttctgttttaatttcttcgctcatctaaacagcacctccttctgcttctttttttactaccagccgcataatattagctcccagaactttaaatatccacaaatatacgattacaggacctaccgcgagcttaatgatcgggagcaacggagcctgcgtggaaatcgtgttaataataacagccgaagccgcatattgataagccacgaatattgtcctttccctatcggttatctccccctgctgatatgcttttttcgtcataaaagacgcaacatcagaactggtgaaggacgctacgaaagcaatcccgctggttccgggaattcccatcaaaggtctgagtagaggtgtaaaaaactttcgtgctgcttccatggcccccatatcttcacaaacatgtacaaatcctaccgaaacacaggttgtgggaatcagtgtcaatgcaaacatgaacccctctctcgctccgactcctccctgtccttcaaaattcagaccatcggcaatgattccaaagcttccaatcagattgcttaaatcaaaagcctttaaaaagttcccggaattagtaaatatcccggaaaaaaggataataagcaagaataacgagccccagccttctatccctatacggtgctcctgctctctgtttttttcttcttttctcattattcggcctcccccttatagctgtccagccggctcagaatacttaaaagcatttttgctctttcagccatcgtagctactattgcaaactctttccccgtatgatttccctgtccaatcacgccgcaggaacagatgaccggtgtcccggctatattgatgtatgctgcatctgagtttccgcccagtacggttgacttcaacggttcttccccgcagtcctgaagtgcctgactgcaaaaatcaaagagctttttaacagaattggtcgtttcaaatgcattaataatgcttaaaaccttgtatgtagtttgtgtacccggtatatgagtctcatcgagggcagcatagaggtcatgttccagtttttccatttgggacggctttataaaccgtgcgtctatctcaatacggcagctgcctggaatggagttagaaactgtgcctccttttatggttcctacactgacagttattccctccgataaatttgttatctcacgtagcctgcaaattttatatgccatctcttcgattgcattcctgcctgtctcaaaactgtttccggcatgagcttctaccccggtgacttccgccgatatagttattccgccttttcgtccaacacacagcgaaccgtccggaagccctgtttccatattaaaagcaaattcacagtttttagcttcttccaccagcgtttctgcagttgtagaattttcatgggcaatttcttcatcaccggcaaataatattttaatcggacgctctgtaaaacccaagctgttcaacgccttaataacataatatgctattataatgccccctttcatatccaggacgcccggtccatatgcccttccgttttcgatacggaatggattgtctgccagtgttccctttggaaaaaccgtatcataatgtccggaaaataaaatcggctttccttccctctccctgcctaatatccctgttaatgtcttccccgcagcccctgtatcaatcaggtcacacctaaacccgatgccctcaaacattgccttaagtgtaccggctgcctcctcaagtccctctttatcaaaagagcccgtttctatttctaccaaccgcttccagtctttcaccatattatccgtatttgcgtctataaattggccgcattgttccctattaatcataaccttctccttcttagacttattattaataaaatttcagccatgtggccgcgggtatgccaaaaggggagcgcgcttcttccgaatccgtcaggcatagacacaggtcaccggttatgttaagattatttatgtgcactaaacaatatttaactatgaattcattgtaacatcacactattgtcatgtaaaatattgataaaaaataggatttattcatttcttgtataaatgggggatttatatggatctaaagcagttacagtattttttaacaattgtagaagaaggctctattactgccgcagccgccaggctgcacgtcacgcagccgccaggctgcacgtcacgcagccgccgcttagccagcagttaaaaaagctggagaaagaatttaatgttgttttattcgaacgcgattcccgtaatttacagctgacagccgtaggccagatgtttgcagaccgcgccaggcagcttcttgctctaagtaacgtgatacaaaaagaaattgtggatttttccagcggatataagggaaatttatacattggcataacccctaccgcagtaccgcttgtattatcgcctaaaatagcggaatttcatcagaattatccgatgattaattttgaattttttgagggaaatagcgcttatatccatgatttggtgcaaaaaggcatcatcgatattggcattatccgttcccccttccatcttcagggtatcaaatatttgaaaaaagagcctgagcctatggttgcggtcatgtctccggaatataactggtctgactgtgtaagctgctccgtcgatgaactggatggaaaacagttgattatataccgccgttatgaatcaatcttaaatgaagtatttaatttacataatgtcctgcccaggattatatgtaaagcggagcgttcttcatccgctttgcgtgcggcagaatccggactcggaattgcccttctgccttcgggagcgacacagatggcccaggaaaaaattgtacagaaaatattggatgacgattgtctttatacaagtcccatggcaatctgggcatatgaccattatctgaataagtctgcaatggcttttttagattatttccgttcattataaaacggtgacctgcacgctccgcgcacaggtcaccgtcatcaacagaatagagctgttgtgatggcagtctgcataccgccttcacaacagctctacttctatcccgcgccttactgcatctttccgtctccgcctatcgtgtatccgtctatcaccgtattcaccgccatgcttccgtcttcatagaaataataccactccgacggcgaaatctgataccagccgactgccatagcgcccgttgaatccgtatagtaccacttgtcattcaggttcagccagccggtctgcattttacattccgaattcatatagtaccattttccattgattaagcgccagcctgtggctgcataaccgttctcatcaaaataataccatgtaccctgaatataacgccagccattgttggcttccactccgttttcatccgtatagcggtagcccgtgcgatcctggcgccagcgtccccctacctcacccaggttgtctacaaatgaatcctcggaggttacataatctccggttcttctgtagccggcatctgtgctgttcttcgaggttgctctgacttcatagaaatagttggcctcttttgtgatatactccgtcaggtcaacattcgtaccctccagcgtcagcgtagtcacatactcatcgtctccccggtagaggcggagctgatatgcggttgcatatgggacctttttccagactgcttttgtccttgtcgaatcactccagccggctttctccgtctgtccaagctgaactaccggataatagtttacctttaccaccaggttgccgtcttcattccgtttggcagagacaaaatccgctccgcttatggtagtctttttagaagagtaggaactcgcaaaagctttcccgctgccgggaaccagtgtaaccgaagccgttattttggaacccggattccatttctccagagccttgctccaggaaatatcctccacctcgcagccgcttcctgtagtcacggttggctccagaatcttaccttcctctttatcataattatttttaaatgtcactctgatattggcaatcgtcgtatccgcatatgctgtaaaggcgctgcccgctatgagcattgccgccgctatgcagatccataagccccgtgttcttctcccaaacataccactacctcacttttctagaatttatgccgctgctccttaccggcgccacacaccgtcggcacctacataaaatgtgctgatagtcgtgttaacagccatgcttccgtcacccggatagaaataataccagtttcctcccacctgggtccagccctcgcacattacgccgttttctcccagataatatctcttgccgttgctgtccagccactggttcttaaacatcgctccctctgtgccctcaggtcccggattcagataataccagccgttggccgcctgtacccagccctttctcattgctccgttgttgtccagataataccagtttccgttcttctcctgccatcccgtcagcatccagccgtctttgtcaaacagataccagatattgttgaccagcagccaggaatccttctggaaggttccgtccggatagcggtaccaccagcggctcccatcctggatccagccgacctgcgacgtggaattattggcagcgctgtttgtattgttgtaatcaatcttgccggaaccattggacaccgattccttggcaatatacagctcatccgactccgtccagtcgctgctgtcggcgtagtccttctggctgtcgcccgacggtgcggaacgcaccttaaaggtataagtacccgcactcgtcatgtatggataaaaattgatcgacgtgcccttgtacgccttcaccttatatatggcgctgctgcctttataaaggtttatatcataggcgtccactccgttcactttatcccacttcgcgtggcccagctgattctctttccattcggcgtcctcaggggcgtcatattcgccctttaccggcttcgtcttcaccgtgactaccagagtatcgtatccctttctggaagccgacacaaaggtgccgccttttaccgtgacattgctggatttataggtcccgacaaagccgtaggaatccggatcctccgcttccagccacacttttaacgtataggtgctgccaatcttcacatccttcgatgtggagctcacccactgcgcctcagttgccgtataccgctcgtttcctgcccttacattaaacccgctgtcttttcccgcttccagatccggcaggctctcgcccgcttccaattccaggtccagattaatcgttaccttgctgattgtctttctggacgaagcggcataggaaaccattgcccctccaaacgccatacaggtcaccaggcatatagaaacaagcggaccaatccacctgttttttctcttcatatccctcatcctctccggcggaaaacatttttcttgctgttttttccgctgtttttataattttattataaagcgttccactattacagtcaacttacgatattcttgcggcatagatggataaaaaagaaatacttctaattccatttctcatataaagccgctatgttatggatccggcgcttcatctccctgcagacatgtaccggccccaaacactcgcatttatccccaaagcttaaaagaatattgtaatagtattcattctctatgaaggggagagtgacaatgtaatgctcgtcaccatccggagtaaaatgatcatacgaacaaaaatcaagtaccctgtccatgacagatttatgaatacgaattttgatttttatctgcatggttgtataaatatcagtaaaatccaactggggtttttgataatcccgcggtgtaaaagcttcttccagcatttccaggtttgatatacgggataatctgaataaacggtaatcatttcttttatggcaatacccctgccaataccagtgattactttttaatatgagctggtacggctcggctgtccgtttagaaaaatttccgtatctgtcaatatactcaaatgaaagcagcctgctttcctgtaaagctgttttaataatttccaaatatggctgcatattcctgttacccatccacggatttaaatcaatacatatctggtttacttttaattcaatgtctttcgctctgtcggcagggataaaacttttgacttttgcaagggcatgtaccagttcgtccccccgtatcataccggaaagactggaaagccccattaggagggcggaaagctcggaagtcgaaaaaacctttttatcaagcttgtaatcctgcatgatttcaaagccgccgcccaccccggatgccccccggacaggaatacccgccatgttgatcgcctctatgtcgcagtagattgtgcggggggaaacttcaaacatatccgccagttcctgcgcgcctatgcgctttttatcaaggagtatcataattatgctaacaagcctgtcaactttcatctgtcgggcaccttccaatttttttatcattatagattgttgccatacagttgtcaacaattgcagagtataataaaaaggcaggcaaatcaactgcctgtcaggtggaaataatatgaaaatggaggaaacttatgttcacaatctatgtttacgttcttgatgctttggccgactgggagcttggctatgttatttcagaggtgaattccggccggtttttcaaaaaggacgctcagcgcgtatcgctcaaaaccgtcagttattccgggaagccaatcaagacaatgggcggtctgacaatcatgcccgactgcctgattgatgatattgctgtgagtgagacaagcgttctgctattatcgggcgcagacacatggaatgatttaaagcacggggctgttattaaaaaagcagaggagcttctctcgtcaggcgctttggtgtgtgccatctgcggggctaccgctgcgcttgccggagccggactgctggataaccgcccccataccagcaacgggccgggatttcttgaaatgttttctcccggttataaaggccaggatttttacattgacaagccctctgtggcggataacaacctaattaccgccggctctgccggagctttgctgtgggcgaaacagattattgggcatttaaacgtttttcagccggacacgctggaatcctggtatgcatatttcaccaccggtaagcctgaacatttctttgccctcatgcagactttaccgtccggcaaggaaagctgaggaccgttaaacgataacctgcacgctccgcgcacacgtcaccgccgtaaattaaaacgactccagccactctgcatggctggagtcgtttattaacgggcagtgaaatgtttacaaaacaaacgtttcaccgctttgtttactgattaaacaagctctaataaaacttccaaagcgccgtcgcccttacgctgtccgatcttaacgattcttgtgtatccaccgttgcggtttacgtatttaggagcaatctcatcaaagagttttgccggcatatctacttcttttgtgtttttctttctgcctgcttttgcagccggaacttctgttacatcatagagaacctttaacatctgtcttctagcatgaagtctggatggtttgtctttcttgatctctttctctacttcgtcatagacggtaactttctttccgtcaacaacttcttttactctcttgccgtctttatctttacgtgcaacctttgcagtaacttttacggtctcgaagttgtctttttccttaactgccatggcaattaagccctcagcaatcttctttacttctttggctctggcctcagttgtaacgatcttgccgtggtataacagattggtaacctggtttctcagtaatgcttttctctggctggaagtctttcccagctttctatatcctgccatgatttaatcctccatatttgtggaagccggcgtccacgcttcattggtcttactgtccgcctgctttattcgtaaacgcccggctgtgccctttggtcttatctgccgggtgctcaaacattcgttaaaattaagcttcttcgctcggattgagctgtaaacctaactcttttaatttggcaagtacctcttccaaagatttgcggcccaggtttctgaccttcatcatatcttccggagtcctgttgcacagttcctccacggtgttgatacctgctctctttaaacagttgtatgaacgaacggataactccagttcatcaatgttcatctcaagcactttttctttctcgttgtcttccttctctaccataacttctgcagttctggcattctcagaaaggtcgatgaaaaggttcaaatgctcgctcagaactttagctgccaggctgactgcctcatcaggagcaagagttccgtttgtgaatacatccagtgtcagcttatcaaagtcggtaacctggcccacacgggtattctcaacggtcatattgacacgctctaccggtgtgtagatggaatccacagcgatcattccgattggaagctcgtcgttcttgttcttgtctgcgctgatataaccacggccttttgtgatgttcagttccatatagaacttactgtccgtgccgccgcttaatgtggcaattacctgctcaggatttaaaatctcaatgtcagaatccacctggatatcagcggctgttacgacgccttctccctcgaattcgatataagctgtctttggctcattcgtttcgctcagattcttaattgccaaactcttgatgttcataataatctcagttacgtcttcctttactccgggaatcgaactgaattcatgcaaaacgccatcgattttcacttgacttactgctgcgccaggcaaagaagagagcataattcttcttaaagaatttcctaaagtagttccgtagcctctttcgagcggttcaactacaaacttgccatatcttttgtcttctgaaatctcagcaatttcaattttcggtttttcaaaatcgaacactatagcccctccttttgggaacttttattgagggtctgtcatactcttataaaataagagaagaactttcgctgcgggtaacggcgaaagacgcggttcacgtccgttaccgccaaccggcgattttgccgctgtccggcccgtgaggggccggacagcaacaaaaaatttagtcaactcttaattatttggagtataactcgacgataagcacttcatttacaggaacatcaatttcgtctctggttggtaactctttaacaacgccttttaagttttccatatcagcctctaaccatgctggtaccattcttccggcggttacctctaagatatttttatatctctgtgaagatttgtatttctctttgatctcgattgtgtcaccagctttaacgcggtaagacggaatgtttacaggttttccgttaaccagtacatgcttgtgatctacgatctgtcttgtctcttttctcgtacggccaaagcccattctgaataatacattatccagcctgcattccagaaggatcataaggttggtaccaacctgtccggacattttggaagctttcgcataataatttctaaaaggtttctctaacacaccatagatgaatttggctttctgcttttctcttaactgcagaccatattcactcatctttctattggctctttttaactctctcttggatttcttgtcgattcctaaataaatcggatccaggtcaagagatctacatcttttaagtacaggaactctatctactgccactttacttgcacctcctaattagactcttctacgttttggcggacggcatccgttgtgcggaaccggagttacgtccttaatgctggttacttcaagaccacatgcctgaagggcacggattgctgcttcacggcctgatcccggaccttttaccataacgtctactgactttaagccatggatgagagctgcctttgtagcagtttctgcagccatctgagctgcatatggagtagatttccttgaacctctaaatcccagaccgcctgcacttgcccatgataatgcattaccctgtgcatctgttaaggtaacgatcgtgttattaaaagatgactggatgtgcgcctgtccgcgttcaacgtttttctttacacgcttttttgtcacttttttaccagttgacatttttttagccattttaaactaacctactttcttcgattacttgaatcctgttacttactaacctgattcacaacttatttgttaccaaatgaattatttcttcttgtttgctactgtctttctcggacccttacgtgttcttgcatttgtcttggtcttctgaccacggacaggcaggctctttctatgacgaattcctctgtagcatccaatctcctgaagtctcttgatgttcatagcgatttctctacgtaaatcaccttcaacagtctgactttcagcgatgacaccagcgattctctttacttcgtcatccgttaaatccttaacacgtgtgtcaggattaacgccagcctctgcaagaatacgggttgaacttgttctaccgataccgtagatgtaagttaatccgatctcgacgcgtttttctcttggtaaatcaacacctgaaatacgagccatgtgtgtagtacacctccattagtttttttctttcttcattgagttgagttaaaataatgatgtattatgccaatccatataccagcaggaattcatgcttcaaggacgaaaatcctgagcagctatgaacaacttatcctggtggttcatatagaaagccgtgcgaaaaaatcaggcagacaaatgcttatcagccctgtctttgtttgtgctttggattttcacagattactctgatactgccttttcttttaatgatcttgcacttttcgcaaattggtttaaccgatgatctaaccttcacagtaattctcctttccgtaacagtccttacacaggacatacaatattgataacacccattgcagtccttacatgccggacttacaggtacagcaggcgtctctttcctttaaaagcccgggttccggcaaaagggcggatctcacctgttgcttcaacaaagttcgctagagcattataacactaatttctatataatgcaagcataatttcccggtatttctaatccccggtaacagtccgttactgttcacccaccgcaaaaagcggtgtgctgcgaacaataacacgctctgcaatggcggaccggatagctgtccggatgctgagtacagcccataagcctcaacgccagcccgttctcccgcaatgtgaggactatgggctgtactcaggggacagcgttcagtcccctttgacgtttccatgtatcatttgccgcagtttcgccgtaagctgagctgcagcttatttatctctccagataattcttcccttggacagatcatatggagacatctccatcgtaaccttgtcgcccggcagaatcctgatataattcatgcggagttttccgctgattgttgcaagtacgatatgcttgttctccagctccactttaaacatggcattcggtaatttttccaccacaacgccttcaatttcaattacatctgcttttgacataaacttttatacctccctggttatgtgaatttcaccggttttcatccggcgtctctaaatgattcgccctgtactgtttgatgaagtatttaatctcttcatcggtaacggtgctgccgctcataagcttatcgcaaagcttttcatcgcagatgcgggatgcctgaacgtgtttcttcttcttgcgtttcggttttcccacggtccggagtcttccgtccgccaggtaaacatattccgcatcttcttttattatgataaatatgccttctttgtcatgaccggccaaagaccaggccagacagcctgtttcatatcctgccatcttaccacctcgaatcagagcattgacaaaatctctggtccatcctcggtaatgagaatggtattttcataatgagccgacagagaaccatcatccgtcactacggtccagtcgtcatccagccagactacatcataagttcccgcattgatcataggttccacagccagcgtcataccgggctgcagaagaatgccttttcttcttctggcgaagttgggcacctccggatcctcatgcagatgagttccgattccatgacctaccaggtctcttactaccccgtagccgaaactttcggcatatttctggatagctgcggaaatatcatttagatgattgccaggtttggcaaatttaatcccctcaaagaaactttgccttgtaacttctatgagtttctgcgcatccccgctgatttctccgattccgtgggtcctggccgcgtcggaatgatatcctttatagataactcccgcatccagacttacaatatcgccttccttcagataatgctccctgtgcggaatcccgtgtaccacctcgtcattgaccgatacacagattgacgcagggtagccgttgtaattcttaaaggaagggatacacccatagcttcgtatgatctcttcacccatatggtcaatatcccatgtggacatgccaggcttcaggttctttgcaagctcgtcatgagttttggcaaggatcttccccgcctccctcatcagctcaatctctctgggagatttaatcgttactgccatactgttatgctcctaaaatttcagtgatgctttggaaaacttcttccatatcttttgttccgtctacggaatgcagcacgcctttttccttataatagtcaatcagcggctgtgtctgctcgtggtaaactgcaaggcgtttctgaaccgtctcaggcttatcgtcatccctgagcaccagttctgctccgcatacatcgcagatgccctcttttgcaggaggcgcgaacgtcacatgataggtcgcaccgcaagtcaaacatgcccggcggcctgacattctgtttacgatattctcatcgggaacatccacgtcaattgcatagtcaatagcctctcccctatcggaaagcgctttcgtcaggctctctgcctgcggaatggttcttggaaaaccgtccagtacgtatcccttctcacagtcgtcctggtgaatgcgatccagcagcattccaatcgtaacctcatccggtaccagaagtccctgatccatgaactgctttgccttcatgcccagttcggtaccttccttaatatttgatctgaatatatctcctgtggagatatgcgggatctgatatttctctgcaattcttttggcctgcgtccctttgccggcccccggtgctcctaacataataatcttcataggcttacctccccgataaaacgataacggtaacttttcagtaccctcaaaaacaagcttcctgcaaatacaacgataacctgcacgctacgcgaacaggtcaccgacttcaacagaaacgcccctatgcaggatcagcccggctccggatcgtccggcctccaggagctcctgcttagaaagcgaattgttttaatcgtttaaaaatcctctataattacgaacaagcatctgtgcctcaaccgctttaattgtctcaaggacaactccgacgataatgataagggatgttccgccgaaagacaggcttcctacggagaaaattcccgacaccataatcggaatcaggcatacgacgatcaggccgcaggccccgataaatacgatataatttaaaatgttgttcaggtaatcagatgttggcttacctggacggatgcccgggataaagccgccggatttcttcatattgttggcaacctctaatggattaaatgtgatggatgtgtagaaatatgcaaacaccacgatcaaagcaatatagaccaccataccaattgaataaaccggatattccgcatggaaccaggaaccggagttaagagctcttaagatttttccgccgaatgtggcgtaatccacctggaaaaactctgcaataactaccgggaaagacatcagggaagaagcaaaaataacagggataacacctgccgtatttactttcagaggaatatttgtagactggccgcctaccatcttcctgccctgcatcttcttggaatactgaacgggaattctccgctctccatcctgcagtacgataacaaatactaccatggcaaggataattgccagaatgataatcagggatacggtcgccaccggcacgttctttccgacaaggaacctctcgtacagggtaatcatatcactcggcaatgtggaaatgatgttgaacagaaggacgatggaaattccgtttcctacgccgcgctccgtaatccgctcaccaatccacataagcattgcactacctgatgtcattgtcgcaatcgccacgataacgctgaccgcattgaagtcgataagaagacctcttccgccaaatcctacggacatggctatagactgcatcagagcgaggcctacggtcagataacgtgtgtattctgcaattttctttcttccatcctcgccttcacgctgcatctcttccagttttggaatcgcgatcgttaaaagctgcatgataatggaagatgtgatatatggcgtgatgctcaaagcgaatactgacatgttcgtaaacgaaccgccagtaatcgtattgaaaaatccaaatgcatcgctggactgtcttgcgaacagttcagcaaaaaactttgtgtctactcccgggatcggcagctgtgaaccgagacgaatcacaaccagcataaagaaagtgtagagaagcttttcccttatttcctttatcttaaaagcgttctggagtgtttttaacatattagatcacctcgcaggttccgccaactgcttcaattttggcttttgctccttcactaacagcatctgctttcacagtgagtttcttggtcagctctccgttaccaagaattttaacgccatcgcgtgggtttttaacgatacctgcttcgattaatgtttctactgtaacaactgaatcgttgtcaaatctctctaagtcacttacattgataccaatgattgttttagagtttctatttgtgaatcctctcttcgggatacgtctgtataaaggcatctggccgccttcaaatcccggtcttgttgcaccggaacgagctttctggcctttgtgtcctttaccagcagtcttaccattacctgaagcgtgtccacggcctcttctgaagctgtcgctgtgttttgaacctacagccggctgtaaattagataaatccatgactgcacctcctacgtggattttagatttcttcaacttttaccaagtgtcttacacactgaatcatgcccctgaccgcgctgttgtccggcatttcaactgttttgtttaatttctttaagcctaaagcttcaacagttgctttgtgcttcggaacggcaccgataggagattttactaaagtgatttttaatttctctgccattttaataccctcctattagttcagaatctcttctacagatttaccacggagttttgcaacttcttcaggtgtcttgatttcgcataatcctgcaagagtagctaaaacaacgtttgtcttgttgttagaacccagggattttgtacggatattcttgtatcctgcaagctccagtacggaacgtgccgggcctcctgcgatgatacctgtaccttcaggagccttcttgagaagtacatttgcacttccgaattttccaatgaagtcatgtggaatactgttattgtcatcaaatggaacagctaccaggtttcttgctgcagcttcttttcctttacggattgcttccggaacttcagcggctttacccatacctgcaccaacgtgtccgtttttgtcaccaactactactaatgcggagaatctcattgtacgtccgcctttaacagttttggatacacgtttgattgccactaccttatcttctaactcgaactggctggcatcaatttttgtacgtttcatgtgtatgttctccttcctactagaattccagaccagcttctctagctgcatctgctaatgcctgaactttaccgtgatatatgaatccgcctctgtcaaagacaacttctttaatacctttttcgattgctctctttgcgattacagtaccaacgtaagcagctgcgtctacgttgtttgtcttttcaagctctgctttgattgctttctctgctgttgaagctgcaactaaagtattgccaactgtatcgtcaataatctgagcatacatatgattattacttctgaacactgctaaacgcggtctctgtgctgttccagaataacgattacgtaatctagcgtgtttctttacgcgaacttcgcttcttgactgtttgctaaccatctttacactctccttaaattatttcttaccagtcttaccaactttacgtctgataacttcatcagcatatttaatacctttgcccttgtacggctcaggtcttctcttgtctctgatttcagcagcgtattggccaactttttctttactgataccttttacagtgatcttgttctgtccttcaaggactgtctcgatgccttctggatcttccatctcaaccggatgggaataaccaaggctgagaaccagtttcttgccctgttttgcggctctgtaacctacgccgttaacttccagaactttctcatacccttcggtaacaccatgaaccatgttgctgattaaggttcttgtcagaccgtgtaaagatttcatcttctttaagtcgttaggtcttgtaacgataatatgaccatcttcttctttgattgtcatttctactggcaactctctctcgagtgtacccttaggaccttttacagtcactaaattattctctgcgattgtaacagttacacctgccggaaccgcgattggcattcttccgatacgtgacatgccgattacctcctacttagattctcggagaagccattggcggcttctctgttttcagttctactactatttttctatcaccaaacaaatgccagaacctctccgcctacgccgagctctcttgcctgtctgtcagtgataacaccctggttggtagagatgatagccacacctaaaccaccgagtactttcggcatttcgtctttgtttgcataaacacgaagacctggtttggaaattctcttgataccggaaatgattttctcatttttgtcttttccgtattttaattccatacggattgttttgaaactgccatcttctacgatgtcatattttctgatgtagccctcttttacaagaatgtcagcgatagctaatttcatcttggaagacggaacatcaactgtatcatgtttagcagtattggcattacggattctcgtaagcatatctgcgattggatcgctcattgtcatgtgagttttgcctccttataatttcatcctgccacttcggtgagtgggtcgactcttatccttccaccacacgtccactcagctaagttcgtctgtcgcctccggctcggactcactaagattcgggacgggctttcgcactagactcgataatacctcgtcgagtgctcaatgcctaccagcttgcttttcttacgcccggaatctcgcctttgtaagctaattcacggaaacagatacggcagataccatattttctcaagtatgcgtgtggacggccacaaattctgcagcggttatattctctggtggagaattttgccggacgctgctgtttaatcttcattgaagtcttagccattgataaatcctcctattattttgcaaatggcatgttgaacagtgttaaaagttcacgtgcttcttcgtctgtcttagcagttgttacgaaaataatatccatacctctgactttatcaaccttatcgtactcaacttccgggaagataagctgctctttgataccgagtgcatagtttcctctgccgtcaaatgcgtttggattaacacctctaaagtcacgaactcgaggaagtgcaaggttgattaaacgatcagcgaactcatacatcttctcaccgcgcagtgttaccttacaaccaattgccataccttctctgagcttgaagttagcgactgatttctttgcttttgtcagtactgccttctgtcctgtgataatttccatatctcttacagcagagtccagaactttagcattttcttttgcttcaccaacgcccatgttgacaacaattttgtctaacttcggcacttccatgacatttttatatccgaattttttgatcatggcttctgtaatttcaccacgatacatttcttttaatctagccaacttaaatgttcctcctctctgtattagtcaatcactttaccggttgcttttgcaacacggacttttttgccatctttaacttcaaaaccaactcttgttgcttttccatcaacgacaagcattacgttggaaatgtcgataggaccttcctgatggataatgccgccctgctggttcgctgctgatggtttggaatgcttggtaaccatgttgcatccttcaaccagaacagtgtttttctttgtattaacggaaagaatttttcctgttttgtctttatctttgcctgcaataatctttaccaggtcatcttttttaattttatgcacagttgatacctcctacagtacttctggagccagggaaacaatcttcataaactgcttctctcttaactctctcgctactggcccaaagatacgtgtacctttcgggttcttgtcatctttgataataactgctgcgttctcatcgaatttgatataagaaccgtctttacggcgtgcgccttttacagtacgtacgacaacggcttttacaacgtcgcctttttttacaacaccgcctggtgttgcatctttaacggtggcaacgataatatcaccaatatttgcatatcttctagtggatccgcccataacacggatacagagtaattctttagcaccggtattgtcggcaaccctcaatctggtttcctgctgaatcatgcccaatactcctttctgatattaaaattatcttgctttctcgataatctcaacaagtctccatcttttgtctttggagatcggtcttgtttccattacttttacggtatcaccgatagtacactcattgttctcatcgtgtgcttttaatttatatgtctttttaacgatcttaccgattaaaggatgttttacatggtttacgatagcaactacgattgtcttatccatcttgttgcttactactttaccagtacgtgtttttctaagatttctttccacggtagatatctcctttccttgttctaggaatctattgtccagtcaaatttaccgcaaccactgcttgttcagttatgcgtttgctttttctgtaataacagtctgaattctggcgatgttcttgcgaacctctttaattctgcttgtattatctaactgatttgttgcgttctggaatcttaagttgaaaagttcctttttagcagctactaattcttcatttaattctgcagctgatttgacttttaaatcttctacatacttattaattttcactgttatcaccgccttctaaatctgctttagaagcaattttgcacttgcaaggaagtttatgcattgcaagacgtaacgcttctctggctgtctcttctggtacacccgcgatttcaaataatacacggcctggtttaactactgccacccagtattcaagtgcgcccttaccggaacccatacgagtctctgccggttttgcggtaactggtttatccgggaaaatcttaatccatactttaccgccacgtttgatgtaacgggtcatggcaacacgggctgcctctatctgattggatctgatccagcatggttctgtagagactaaaccgaattctccgtagcaaataacattgcctcttgtagctttacctgccatagaaccacggaactgtttacgacgttttactcttttaggcattaacattatttatcgctcccttccttgtttcctttagcaggaagtacttcgcctttgtagatccaaaccttaacgcctgtcttgccgtaggttgtatctgcctcagcgaaaccatagtcaatatctgctcttaatgtctgaagcgggattgtaccctcgctgtagaattctgtacgggccatatctgcaccgccaagacggccggatacggatgctttgatacctttagctcctgccttcatggatctgcccattgcagacttcatggcacggcggaaagatacacggttctgtaactgctgtgcgatattctcagctactaactgagcgtctctgtcggctctctttacttccttgatgtctacgaagactctcttgtcagttaatttctgaatctcttttttagttttctcgatctctgcgccgcctttaccgattacaacacccggcttagctgtgtagatgacgattttcactttatcagatgcacgctcgatttcaattttggaaataccggcgctgtataatttctttttcagatatgttctgatcttgtgatcttctacaaggttgtcagcaaaatcagcttcagcataccattttgagtcccagtctttaataacaccgactcttaagccgtgtggattaactttctgtcccatatttgcctccttttatctctcatcaagcacgatcgtgatgtggctcattctcttttcgattctgtacgccctgccctgtgctctcggtttaactctcttcattgtcggtcccttgttcgcgtagcactcagccacatacaggttctccggattcatctggttgttattctcagcattggcaattgctgattcgagtaatttctttattaaagtagaagcatatctggaattgtaagttacaataccgagtgcagtctgcacatctttgcctctaatggcatctaatacgaaacatgctttctgaacagatactctggcataagacagctttgctgacggtctggtatccttctgtgcatttctctctctcttaatttgggatctatgtcctttagccattggtgaaacctcctttcaaaagcgtaaaattacttacggcctgctttcttttcgtcttttccgtggcctctgtaagttcttgtagctacaaactctccgagtttatgtccaaccatatcctctgtaacatataccggaacgtgtttcctgccatcatgaactgcgattgtatgacctaccatctgcgggaagattgtagaacggcgggaccaggttttgataacctgcttctggcctgctgcgttcatatcatccactttctttaaaagatgagcgtctgcaaatggtccttttttaagtgaacgacccattgaattacctccttgataactactgtttaccgtttcttcttcttacgattaacttgttagactgtttgtttttctttcttgtcttgagaccaagtgctggtttgccccatggtgtacatggacctggacggccgataccggtcttgccttcaccaccgccgtgtggatggtcattcgggttcataacggaaccgcgtacggtaggtctgaagcccatatggcgttttctaccagctttaccgatgttgatcaggttgtgatctccgtttcctacaacgccgattgtagcgcggcagataatcggaaccattctcatctcaccggaaggtaatctaagggttgcgtattttccttctttagccattaactgtgcggagtttcctgcggaacgaactaactgtccgccttttcccgggtaaagctcgatgttatgaatctgagcaccaaccggaatcgcgctgagtggtaagcagttgccgactttcgcttctgcctgcgcgccgctcataactttagttccaacctgtaatccggccggagcaaggatatatgccttctcgccgtctgcatagcagattaaagcgatgtttgctgttctgttcggatcgtattcaattgataatactgttgccggaataccgtcttttgcatttctcttgaaatcgatgattctgtattttctcttagcaccgcctccgcgatgtctaactgtaattttaccctgattattacggccggcattctttttgcctaatgctactactaatgacttctccggtgttgatttagtaatctcagagaaatcagagccggtcatctgtcttctggaaggtgtatatgggctgtatgttttaattcccatgactctaactcctttcgttcaacgccccctggcgttttctaaatttgcgcgtcagcaatgagcagggttcatgtgaagcagaaaacctgtgttgtgttcgcacataagcaggttttttgattcgcaggaacagggcgaatgcccgcgactgaggaaatgcgttttctgcatttccgaagtgccccttcggacttccgtttttctccgtccgtcccttttgcagactccattcttatcacgacatagtgttcgtcgtatagttacctgcagccaagctgcattcgacttataagccagtaaagatttcgatctctttgctgtcttctgtcagctgaacgattgctttctttgtcttagctgtcttgccgaaggtcatacctcttctctttgtcttaccatcgagattcattgtattgacgctctttacttttgttcccgggaacattttttcaacagcctctttaatcatagacttgtttgcttctgtatgaactaagaaagtatatttcttctcgctcatagcgttcatgcttttctcagttaccactggtttgaggattacgtcatagtactgtacgtttgccattatgcatacacctcctcgatagaagctacagcagcctttgttgccactactgtgttgtattttaagatatcatatacattgattgtgtttacggatgcagtcttaactgtaggaatgtttcttgcagataatactgtattgccgcatgtgtcatctaaaacaaccagagctttgtttactttcaggttgttcataacagactggaatttctttgtcttgatttcatcgaaattcatagcgtccactacgatgaatttattctcatttactctgcttgttaatgcagatttaagagcagctctcttctctttcttgtttaaccggattgtgtaatcacgtggtgttggtgcaaatacaacgccgccgcctgtccactgaggagatcttgtagaaccctgtcttgcatgaccggttcctttctgtctccacggttttctaccgcctccggaaacttcggaacgtgttttagctttctgtgttccctgacgtttgttagctaactgagccacaactgcaaggtgtactaagtgctcattcacttctacgccgaatacagaatcgtttaactctaatgtgccaacttcgttgccttcaatattgtaaacagatacgtttgccatctgtgtgttcctcctttcctgtaaagcttatttaccagcttttaccgtttctttaactgttactaaggatttcttaggtcctggcactgcgcctttaacaaggattaagttgctgtctgcatctactctgacaacttccagattctggatggtaacttttacgcttcccatatgtcctggcattcctttgcccttgaatacgcggcctggagtggttgcggaaccgttggaaccctgatgacgatggaacttggagccgtgagccataggtcctctgtgctggccatatctcttgatagcaccctggaatcctttacccttggaaacagctgtaacatcaatcttatcgcctgctgcgaagatttctgccttgatttcatcttttacagaatactcttctgcgttctcaaaacggaattctcttacaaatctcttgtaagcaacgcctgctttgtcaaagtgtccctttactggctttgtaacaagtttttctctcttgtcaacgaaaccaacctgtactgctttgtaaccgtcgttctctactgtcttaacctgtgtaacaacacatggtccggcctgaagaacagttacgggagttaaaactccgtcttcgttgaagatttgagtcattccgacttttgtcgctaaaatcgctttcttcattatttgacctcctgtctttttctacagcggaacgcagtaagctttgctcgccgcgttcatcctagaacagtccagaaatctatctaaatctgttaggatatgcattgaattgaatgctttgctgctgattttgcagcttattttgttttcatctttacgtcgatgtaaacgccagccggcatttccagtctctgcagtgcatcaactgtcttctggcttggagcaatgatgtcgatgagtctcttgtgagttctctgctcgaactgctctctggaatctttgtacttatgaacagcccttaaaattgttactacttccttctttgtcggtaacggcaccggtccgctcacctttgatccgtttttctttacagtctcgatgatttttgcagcggatgtgtcaaccagctgatgatcataagcttttaatgtgattctcattacttgacttgccataaaaaaagtcgcctccttttcgtactatttaagcacgacaagcggtgactgtacacatgcccgggtgtgtcatcttagacctcacacggaatccttctttattttcgggatatttctgtagttgtacagtgacttgtcgccagtttcttcgacttgacattcgctccacggaaaacctgccctgtttcaggcagcaacctcacgcttcatagctatcatgccacagctttgatagcatatcatacatttacagggattgcaaggatttttttcatatttttttgtattattgggatttaattatgcaggtgaggacgccgccggtacggccagcggacggggtgagggtagttggatgagtctttcgtcccggggataggttgtcgtgtgggctgggactgcggagaggatatagtctgcggagcacgtttccactcggtggaatgcatcacgctgctaagctcgatagtgcctcgctaatcagcgatggattccaaaggcatccgcagactatatcctctcctccgccccaaaggtatattttctccgggacaaaagactccgccgggtgtaccggccccgtccactggcctgcggccgctgattgtctcacgcgttaagtgcgagggcggaccttgtcgcggccactcagcgcatccatatgcgtttgatatatgttggatatgggctgatgtagttgcttgagtatatttgctgtgattggcggtgacctgtgcgtggggcgtgccggttatcgtttggtgtaatatcaccgtaatatttaattgaagaactaccacgctattcctactgttagttattggtaatatgtagtggcagcgacaaggttacctcccccattgaggctggagacaatcagcgtccggaacggaccggggccggtgtgagaaaaacttcgcctgagtcttttgtccccggcgataacctgaaccggggaagtaggcggaatcaattgtgcaggggacatgggagtccgccggtgcttagcgaggtccctcacgagcttagcattccgctgcgcactccaataagcgcgagcggtccccgtaacaattcattccggccggattcccccctcacgacaacctccaaccggggacggaagactcagaaaaactccccctcgccacaccggccccggtccgttccggacgcgtcctccatcctcaattactcatcaatctattgtcaccctgcacattgtatattccccatacccggtgaccgcacggtaatacccgcaaagggaaagattacacgcctcatcataggtatctaccagcagcggccgtcctcccagcgccgccagctttgcctttgtcgccagtatgataatattttctttcccgatttcttttatgacctccggggtaagctgctggttgccgcggccgaacagatagccctggcctccggttaccgtcacgatcagttttgttcttcttcctttaatatatgacaaaatcgtatccccgtacaaatcggccgccacaagctttttgccgcatatcagatctactccgatcagagtattctttagacccaaaagatgcatgattcccctggtcgtggttcccgcgccgatgagatagcaggtctccggttccatcgcttctattatatcataggcaatcgcctcaatcgatgccgtctcagagacgggggtcggcgctttgcggttctgtgtcagcgtcttttccctcggcaccagaagataaccataaagccttgtgcttaactcctctctccggtaccgctcttcatcaatgtccaaaacctccagttcctccgtcttctgcaccttcccggtgagccacataagagccagccgtccggcagcctggggatttttcgcatagaccggcgaatgaatctttacgccggccgggattcccacacagggcaccttcagctccactgcctcgtaaatgtccctggccgtcccgtcacctcccgcaaataatagcaggtccacttgttcttccaaaagcttctttgccagctctattgtatctgccgcatccgtatgtcctgcagccgtataccccgaatccgcgtccacagcgtccgttccggccgccgttaaaagcaccgtgggaaaatcaaggctctttgccagctctccgcccatatcaccgggatatgtataaacagtaatctgatctctgatttcaataagctttgttagcgccgcttttacacgttctccggctcttggctgcgctccgcgcctgattgcttcctccaccacatgatccgttcctttgagccccacactgccgcccatgcctgcaatgggattaataataagtcctagcttcttcatcggccctccataaaaagcaggactgctttaaaatgatacccacttcaaagcagtccttcttatatctgtatcacagcgtcttatacaaccgcattgcgttaatagtttcttctataatatatagtgtatcacaaagaatctcaatcgctgtatttttttaagtacattttccatgttgttgcccatctggccggatcatccataccgaattcatccacctgatgcgtgacacttctatgaggcgccgtcttaatgatatcaggattctcatgagcctctttaaatacatattttaatgtctcgatatattcatcgatatctttcttggaaggtgtctcggtaggctccagcgtcatcggctccggcagatagaacgggtgatgggaggtccagtaatgcatcccgaaatccatcatgcgcctctggatatccagtgtgctgatacctgtttctttttccatcgtctccagcgaatagcgcgcctgttcgattctctggttgttgccgtcctcataataggcagtcacctccggaagctccatcagcttcttaaacatataattattattgagaactgcggtcttggccacctgatacaggccgtccggtcccatgctgcggatccagcagtatgccttgagcacaaccggagccacgccgtaccattcccttactttacccactgcgcacggattactgcagatgtcataattaaggaaatatttctcaccgtcatagtccacaatcggagccggaaggtattgaaccagatccttctgcactcccgttgctccgcaggccggaccgccgcagccgtggggcgtggagaatgttttgtggagattgaagaagcacatatcaaagcctgcgtctcttgcccttgtgacgcccaacagcccgtttgcatttgcctggtcgtatccgcaaagaccgccgatggaatggatataatccacaaattctttcacatggctgttataaacgccggtatcctccggatttgccacaatataacctgccgttttaggccccgccgcagctttgagctgctctaaatcgggaacgcccgtcttctcatccggctgtaagtaaacgattttaaagccggctaccgcaggagcggccgcatcggaggggtgggaataaatcgttgtgataatctcatccctgtcttcccctttatctttaaaataagctctcatgaccgaggccatcgttaagattccctgggaacctccgcccggctggaaggtgaaatgatccataccggaaatttcactcatgtatttgtcggtctcatgaaaaatctcaagcatcccctgcaccgtatccgcatcctgaagaggatgatattcgcggattaaagcagataactgctcatttaccttcgggctgtatttaaccgtacaagtgccctgtccgatctcaatattaacatctgcgcccagagtctgctgcgccagcctggcatagtgtcttaagacacggctctgggaaagctccggcaggttcagcttcgtatttctcttcataccttccggaagcgcatcaacgccttttgtctgtccggctatctcttcatccggagcgcccactaagattccgcgctcgcccggagtgctaagctcataaattatcggctcatcccattttgcctggtggaaatgaactctgaccttttctgatctatctattcttttcacgttatcattcctttctgaaagcttatttggtgacttcataaagcgctttaattaaagtatcgatatcttctttcgtatggatttcggttacacagtaaagagcagactcggacagtccggggaaatcctccgataagtccttgccaccgaaaatccctttatcaagcagggctttattaatctgtttcaccgtttttcctgttccgctgaaatccacgacgaattctttaaagaagacgctgccgaacggattggccttcactcccggaatctcatttatcttagcggctgcatactgcgcattggacatgataatctgtcccacctctcccatgccctgcgggcccatggtcgccagataaacccctgccgtaatgccccaaagagccgactgggttccaacgtattctttgccgtgctccctgtggtgtccaaatgacgtcctgtcataagccacatctccaaagccgtactctcccggctctgtcgttggggcaatgccaaagagacgggacgggaattccataacatatttttcttcatctctagtcgccataaagccggactggccgccgccgtagttcatatgaatgcccagcggctgcaaatcaccgcagacgatatctgcgccgtaggatgccggcgttgcgagtaccccgagggaaatcggatcaatgccgacaaggctgagtcccccggccgcatgtactatatcggaaatttcctgtccgttttgctcaatcacaccgagataacccgggttctcaaaatatatgccgacagtatctgcgcctgctttttccttcagatccgataaatcgatgagtcctctctcatcacattttaccttctcaaaacggaggcatgactctgcatagttttccatgattttcagcttctcggcatcgatatactccggaaccaggactacggaacggttcgtaatccgctgagccatcctgaccgtcgtggcggccgcctgcgcccagtccatcgtcggcacattgaccacttccatatcgaccagctccgcaaccatgctggcatattcaaacagcgactggaagcgtccctcgtcattatacggctctccgccgtatgcggtaagaaattcgcctttgccgttgatttcgtcgcaaatggcaggaacatagtgctgccagcagccggcgcctaagaaattaaggtttctgtgacagtccgtatcctttgagaggacacgctccacgtgtcttttcaattcatattcagaacgaaatgcctttggaaggttcatttcattttttaatttcaacagttcgggtacgttcttatgaagctcctctaatgagccaagaccgatttcacggagcatttcctcctgtacttccggaaccgagtttggtatgtaaggatggctttcaaatcctttcatgtgcttgtttcctcctttatatgctgaatatctatattttatggttaagcgattccgccgccgtctactactaatgccgctcccgtcacccagcttgataaatcacttgcaaggaataatactgcattggcaatatcctccggcattccgattcttttgagcggcctgtctgttccgcagtcctttaagtaagcgtcctgatccgcttcttcttttactattcccgtctgcctgccttcgtcgcgcagcatcgccgtgtcggtgtcgcccggatttacactgttcacccggatattcttcgggccgtgatcaatcgccatcgccctcgtggcattgacgataccgcccttcaccgcacagtaggcaaccgcctgatctccgcccttgagtccccagcccgagccggtattgataatgcttccgccgccgttggcctccattaccgggattacatgtttggaaaacaggaacattcccttaagccctacatcgagtacaaaatcccattccttttccgtaaggttatcgattgttttacggaccgtaacgcctgcattgttatgtaaaatattgattggcccgtacttcgtcaccacatcgtccaccgtctttttaacttgttcctcactcgtcacatcacactgaaaaaaggtaacatccctgccggccgctctcagttcctgtgctttttcttctcctttggggctgatatccaccatggcgactttcgctccatatgccgataaaatctccacaactcccagcccgatacctgaacttccgccagtgacaactgcaaccctgcctgtcaaattcaatggttctttcttttctaacattcttttcctcctttagatttcctctcatctcccttttaaattaccaaagcgggagtcaacactttctgtcctactatttagcaatcatcgtgccaactttcacagaatttttgctcagatttggattttacgttgaaaatatttttaaagtctgcaatatcccattaaaatccgggaattttatcgtttataaaaaatcacaggtctacattctaccatatattttcattcctctccttttcaataccaaataaaattgccaaaattgcgatttaccgcttgtcatttgtcaattattgtcaattgacacataattgccaaatttgccattttcactgtcattgctcctgaatatatggtataatgtccgcatagcacagcgggcattattccgcgtataaacggtttctgcgtccgccgcagtaatccggcgctaaatcccacacatgttttcatatgggcactcagcatcaccatcaataaagcattctggtgatatgtcaagaactttttgaagaagattttgatatgtttttcagaaaaaagggtaactttaacagaccttcggtatattttacgtataaccgaatgtcagttcgactcaatattatattcggtgtccagcttttcgccggtgtacagttggtttttgaccagcaatccaaaaacgagtcgtactaatttacgagatgtaagcgcgagtgctcttttgtgctgatgtttggttacctcagcatattttctggcatagaaatcagcatattcagggatgtgcttcctgacgctgtttgccgcttcgccaagatagcagcgaagatagggatttccggctttcgacattttgttgtcctcagaagtgaaatctccggaatcacccttaggccagtaaaggccggcatatttggcaagggcatcggatgaatggaacacggttatatcgcctatttctgatagaattccggatgcccatatcggacctattccaggtatggattgaaggatgagcagggcgttagggttcattccgttgatgcatttctcaatcgcctgctcgatcagcttgatttctttctgataggcgtggatgcagttaaacgagcttgccagtgatatgctcagtggttcatacatgcacttgtctaaccggtaggaatccctggctgccttgcgcaggagttccgaagtttttgataggtcagagatgcggttcctgctcttccccgcaaggaaggtaagcagatcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtacggcctaccctgccaaagtctgcgatgagatatgcatctgtgggatcggtcttttccattccgatataggactttcggtaattcgaagtggcctttgggtttacacagaagacgtaaggcttgtagggcatgagaacctcgctggtcgataggaagtttgaaatatggacgctgtatacagaagtggattccagcacgataagaatcgtattcaggtttttatgcttgtgcatacactcagcaatcatattaacaagcttatcggcacccggctggttattgccaaacgatgatgagatgtatttgttttcctcgaagtccatagcatagacagcattggtctttgagcttacatcaatacctacaaacaaggtggacatatagttgagctttaacatgatatcacctccattccgatggggatttgtgaagcctgaagcaaaaggtttatcctgtgccgcatacggtgaccgaaccctcgcgcaatgagcatgcacccagtcagccttttttgctggggctaacggctggggatgaaaattctgtgtcagcggaatgtgccgtatgtgccaggctgaatgctttcaaagcagtctcggacgaagccggctgaaaggaggagaagcagtgccttcggacatcagactctacctgatatcataccacaggatctacctatattgaaatgtaactatcaactgtatagatgggaatcgggatgaggggagtacctcttagatatccttaccatttatacccaaaaaagaataagtctgtaagcggtttttcttgcttacaaacttattatacgaggaggaataacatggcaaatctggaggaaatccgtgcctcggccgaaaggctggtgactgccgtcagcgatgcgctccgtctggaaatcgctatctttgacgacagcagcaaccttttcttctgcacccctacctacttaaagaaaaaaggccgcgtggtacacgcgccctttatacgggaagtcattgaaaacggcagcgttcttgtcaacaagcccggtgaaatgccgtcctgcattggctgccgttttaaagaacactgtccatccacgatagaggttctgtgctgcattcatgccggtactgaaatcgcgggagtggcatcttttacttcttttacaaaagagggacagcggcgcattattgacagcacggctgtttacctgaatgcaatcaccgaactggccaacctgataggagatcttctggccaataaaacgggaaagagcggttttgccaatctggacgccacactggccgcatccatggagctatgcccccagccggtgcttctcaccgatccccacggagtgatcttgcagtataaccagatggcttccaactttcttaaattctgcaacagtacaagttcatccctctggcagctttttccggaagccgttgtcagaaaaatcatggacggcactaacctgttcgagaaaaacgtgacgattggaaacatggctactaagatcacgacgcgggccgtcatgaacggagagcaaatcagcgcttttttcatccggctttccggagagctatccgagccggaggccgaatccggattttttggaagaattgtcggccagagctctcagattgaaacaatccaccggctgattaaaaaagtagccgacagccctaccccggtcctaatcacaggcgaaaccggaaccgggaaggaactggtggcccgcgccattcacgaacaaagctgccgcagcaaatatcccttcgttgcagtaaactgttcgggtattcccgatactttatttgaaagtgagctgttcgggtatgaagaggggtcttttaccggtgcgaaaaaaggcggtaaaatcggtaaaatagaaatggcacaggggggaaccctgtttctggacgaaatcggggagctgccactgtttgcccagcccaagctcctgcgggttctccaggaatatgaattggaacgggtcggttctaataagaaggttcatctggacatcagaataatcgccgccacaaacaggagcctcagcgaaatggtggcagagcgcacattccgaggggatttgttttacaggattaatgtgatcaatctgaagctgccgcctctgcgttcaagaagggaagatattatgcctatcgccgccagctatctcgagcatctccggtccagaatccggacccctctgaaaaagttcgctccggagactgaggaactgctggtctcctatgactggcccggcaatgtccgtgagcttcagaatatgcttgaatatgctgccaatctctgtgagacggatacgctgactccggcagacctgccggaaatcctgactttgaaagcacggccatgtgaaaaaacggaacccggaccggccgcggtgcgaaacagcggagagcaggtgcttgccgggctgctggaaaaatacgggtataccttagagggaaaaaaacaaatcgcagccgagctgggaatcagtctcagaacactttaccgcaagcttaaccgcctaagcatacagcagcctgatattacactgccacgataaagttctttacatttaattgacagactttaccatatgtcatttcaaactgtcatttaactgacaattaatatctcgttttagtgaaaccagcttgtaaatatattttctatctgtccttttttgcctgttatccatacacttttcatttttcttcacctcattcgtcctttttggcacgttatttgctttttaatccggcataagcggccggcttaacggaggggtgcatccctaataataaaaatgagggtgacaccggccggccgacaaaaaggaggaagatatatggatatgcaagtcaactatgggatactggccttagttccgcctatcatcgctatcggtttatgttttgcgacaaagcaggttctaatctccatgttcgcaggcctctttgcaggttcactgatcatcagcagctggaacccgctggggcatgctcctatgcattatctgtcatatccagcaatatggcggataatgtaatactgttactctttaccctctttatgggtgtcggaatttccttcatatggaagctgggaggcagctttgcactggcggaagccgcgaaaaggcgttttaaaaagagacgttctgtttgtctgggcacatggggacttggaatggcctgctccgtcaacgattgtctggttgccgccgttgacggcaatgtcttccgtgacatatgcaaggattacagaatttcttctgagaaactgtcctatgtattagactctaccgcagctcctgcggccgccttatttatttccgactggatcgcctatcagatcagtatgatcgaacagggtctggaacaggccgggatcaccggaatttcaccggtcagcgcttacataaaaggtctgccgtttaacatgtattctatattcactcttattttcgtaggcatgttaatgtataccggacgcgattacggccccatgctgaaggcagaggtccgtgccctaaaaacggggcagtacaccaagccggatgcaaacccgatgcttgatgtcggcaatgaactgggcgaaccgaaacgcaccaaaccaatgatccgctccttcgtcctcccgattgcagtggcgtttacgattattatatccggtatcatttacacgggctacacaaatccggccagaaccgccaccggcattatggcaattctcgacgcatgtgacgcgcagatggctctttactggggttccttcggcatggcggtaacgggaattgtgatcgccctcaccagccatatcatgacatttgaggaaacgatgaatacgattgtagacggttttaagcttatggccttaaccggagcaattcttgttatggcatggtccttaggctccgtcaccaaaagcatggggctgggcgctttcgtagctcagtatgtcggcgccagcatcccgaccggtctgcttccgcttctcgttttaggatgttccattctcgttgcctttgccaccggaacgtcctggggcacaatggctatcatgacgcctttggctatccagttaggctatacgctcaccggtgatgtagaattctcagtcggcatgtgcggcgcagttctttccggcgctatcctgggtgatcatgcttcaccggtatccgataccacggttatggcctccattttctccggtgcggaccatatcgaccatgtcggaacacagcttccatatgcgctgactgtgggaggtgtcatcgcagttttatacctgatattcggctttaccgagatttcgccgtttgttctgcttccaatcggtgtagtcatgctgtttttcctgcagatcattttgcacaagatttatatgaagcgctataatattgatccgaactatacaaaattcatgactgaagatcatgtaaaacaggacgcctgacaaagagggcaaatcagcccccgttctaaacggggagccggttaaagaaacatacagatgccctcaaatgggttgaaaaagggacaccgcgtcagtcagtgtcccttttcttcattacctttatttattatttatacacctgccagctctccaaccgcccgtatccctgtttctatctcatcctcggtgttaaaccaggaaaagctgaaccgcacaatgccctgttccactgtgcccagggattggtgcatcagaggcgcacagtgggcgcccggcctggtggaaatcccatagccgactgccagctcatcactgacctgcgctgagtcatagtcccggatattgagcgccacaatcggagcgcgtttgtcatctgaaaaatctccgtaaatccgcacgccgggaatctcctttactccatcatgaaatttccgcatcagcttcatctccctgccgtgaatcgcctccacgccaacttcttctataaacgacagcgcggcatgaagccccgctatcccatggccgttcagggttcctgcttccagggccgcaggcatctgcgaaggctgctctttattgtaagtctgaataccgcttccgcctgactttagcggtgagatatgcaatccctcccggacacaaatccctccggtcccctggggaccgtacaggcccttgtgcccggtaaaacacagcacgtctatattcatggcctgcatatcaatctccagggtcccggctgtctgagatgcgtcaacaatgaataaaagattgtgttcgcggcaaaagtttccgattcgtttcaaatccacgctgttgccggtcagattggacgcatgcgtacagacgaccgctccggtatcgggccgaagggctgcctccagtccttcacagtgaagctcacccctctcaccgcagctcagaaatgaaagctctgttcccattgtctccagccggtaaagcggacgcagcacggaattatgttccatcaccgtggttattacatggccggaaccttgtaacagccctaaaattgccgtattcagagcttcggtggaattggaggtaaatgcagtctgcctcggttcccctgcgtgaaacagcgctgcaagttgcacacgcgtgtcataaataaggcgtgacgcatccatggaagcctcataggccccgcggctggaattaccaaggtttttcaatgcctctgtcaccgcattgatcacacagtccggttttttcagcgtcgttgcggcattatcaaaataaattcccatcctaatcactcccctcctcaaaacagcatctgcaccatatcttcccattcaacattttccttcttcagcaggattcccagccgccctttttcaccttcaggcgagcaccaggccaggccgcagcctgccgaaagttccctgggcacgggtataatccggcccggaatcttttcggctttacagcttcgctccagttcaatggcccctgccgtagtgtgaaacgtaataattaccttcggctcttttttccgtatcacggcgctcccccatctcttctaatttatcagaatttcaaattccgtatctttatccgtcacagatacctgcctgccctggctcttcgcatatttttccacattctgcctggcgtatgcttcactgaccagcaccctcaacggtacgccggatccggattttaacgcctgcgctgtaagcagcgccggctccgggcaggataaacctcttgcatccacttcgttcatctctattcctcctgattattattttttatctgtcttctctctctttttaaatcctatcaggaacagcactccaatactgacaacgagaactgtctttccggccggcgtgagtccgcctgacactgcctctgccgtctccgtagctgctgccgccgcccctgccgcaagcccgaagttatgacaaaaagccgctcctaccaacagtcccaggaaagtcaccgctgaatcggacgacccctgaccggccagcacaagctgcctcagagggcagcctcccgccagtacggcagcaaaacccaccgcatacagaccaaggaaattccaaagatgatgggaatgggaaatgggctggccctcaaatgaaagtttaaaaccgcccgtcaacaggttaaaagcaagcattacgatgaaaaagccgccgataatcgataacaaatcaaagtttttcatcaaaaacacgtcacggaggctgcccgcaaagcaggccctgtttttctgggctattgcaccgaataaaagccctgcggccaaagatatgagaacaggggcatgcatgctgccggggcctgtctcgctgctcgcaaataatgctgtaacattatataatagaagcaaaactatcagaagtacgggcagcaccgcccccgacccgtttgacgacggataggcccggcccagggtaaatcccctcttcagcgccgccgtaccggtgaatacgcctgcgccaaagcccagcagcccgacataggcattcagatctccggccgacatgcggatgagcatgcgcagcgggcatccaaggaatgccagggagcctgccatcatgatgaagcccagaaggaaacggagcatcggtgaagaaccggctgcagaacggtattcctttgttataactgctatcaggaacgctccgcagacgaatccggctatttccggcctcatatattgtaccgcagaggctgtgtggagtttcatggctccggcagagtccctgataaaacaggcgacacaaattgccatattctttggatttcccataaaggccagaagcgcgcccaacaggcccatcaccgctccgctcatcattaaggttcttttattctgactgatattcatctgctcccactctccctttattatttatataatatacggacatccccctgcttttttgttatcttgcgctggtcaaatgcatccagcagcatgactgcatattttctggaggttcccagaagatcccggtactctgcaagtgagatatcaggatgcgtatccagatggtttttgaggacaaaaaccgccttttcccattcctgttttcccatatagatgccgggggcggctttgaccagagcatcctgcctgaccagttccgtaataatctgccgggcctgctttttatccttaaagccgttaatcacttcatctatcgtcggcgcttccacaccggctaagcggtaacgctcccgtatggcctccatcataccggacagttcaccggaacagcctcccgtataaccgttcagggcagccgtacttccggaaacggtcacgatgccgcgtttcaccagctcctggaaaagctcttcggaccgtttcgcatccttcagataaaaatgttccgtcagacggcttttcagctcctccttttcgataccggaggcaatgggatttgcctcatgaaaacggttcaggcattgctttgcaaactcggtgattatgtcccagcactctttgtgaatacagctctttccgttgacggccagaattttcttctgcttttttaacttttccagcagctcctccgtatgggcgggggctgcattcagtctcagcgacagctcggaaagctccggaaaatatctgcttctctcctttataattgcttccaatacttcatcatcccggccgtattccttgattttgagaatatccagcgcctccttctgacagcgcttatgttttccggcgtccgcctccaggatgactccgcccccaaatgtctccacaggggaataaaagcggataataaagtgatctccgcgtttaacggaaaccggttcgtcaaaacggagctgtgcataggcctcttctcccgcttttatttcatcacaatccaaaagaaccactttacagatggactgagccgaaccgtaactgatgtgtacccggtccccattgcaaagcagacgccgggagcttttaaaaagccgcactctggcgtcaagctggcggctgaccggcatggagcccacagccgcaagaatctctccgcgctccagttcctccttcttaattcccgccagattgagggccgtgcgctggccggcataagcagtttccgccttctccccgtgattttcaattcctcttatcttgacaatgcgtccctggggatagacttctatctcctggcccagcctgcagcagccttccagcagcgtgcccgtcaccaccgtgccaaacccctccattgaaaacactctgtctatgggaagacgaaacagttcctgctcatccctgcgttttgccgtatcccgaaccgcttctagtatcattttgcgcaatgtctctatattctgcccggtataagaagatacgcggacagactgggcattttcgaggaaacttcccttcaccatctccctcgtgtcctcttccaccatatccgcccattcttcgtccaccatgtcagccttggtgaaaaccagtattccctgccgtatgtccagcattttgagtatctcaaaatgttcggttgtctgaggcattaccccctcatccagcgccactgccagcagcaccagatcaatgccgccgattccggccagcatgtttttgacaaaccgttcatgtcccggtacatcgatgattccaatgtgctgcccttcctccccggacagactggcaaatccaagctcaattgtgatgcctctcttttgttcctctttcagccggtctgtatccgtgcctgtcaatgccttaatcagacaggttttaccatgatccacatgacccgccgtaccgactattacattatgcatcctgccacctcacctgattttgtttcgaaaatgcctcccggatccatttaaattccgtctcttcgatggtccgcaccgacagccacagcttatcgcgcgccactcttgcaatgatcggaagttcctctttgcgcagcagccgttctgaacgctcggcgttaaagtcctcccctgatacggttaccgcataaccttccagcatcaccagaggcgcagagcctccgcccacctgatccctgcacggctccaccataaactccagggaaggcgctgcttcagagagctgaccgcacagcttttcagccttctctttaagccgtatccctgtctccgtaatcatgcgcagaacggggatttcccgcatagcccgcttggaatcctggtattcgaaaaatgtcgcctccagggcggccagcgtcattttatccacgcggaatgctctagccatgggatggcccttcatccggtccacatattcctttttaccgatgacaacaccgcactgaggccctccgagaagcttatccccgctgaaaagcaccacatcagctccctctttcagcgcttccgtcacagtaggctctccgatgccgcagccgcttaaatccgtcatcagcccgctgcccatgtcataaataaccggaacagaaaattcctccgactcatccctcaaagccgccagctcccgaatcgatacttcctgcgtaaaaccgacaatcttataattgctggtatgcacttttaaaaacgcgccggtcatctctccatgaaacgcctttctgtaatcagccggttttgtcttattcgtggcgccgacctccagcaggtgcgcgccgctctcttccatgatttccggtattctgaaggatccgccaatctccaccagctcgcctcttgaggtaatcacctcttttccgcgggccaatgccgagaggcacagcatggtggccgcggcgttattattcacgaccatagcggcctgcgctccggtaattttcctgatcaactgctccacatggtcatggcgcgaacctctgctacctttctttatatcgtattccaggtttgagtaataaccggccgcctccaatacgctctcgcaggctctccgggatagattggctctcccgagattggtgtgcaggacaacgccggtggcgttgatgacacggcgcaggctttttccctgctcttcaaagaccctttgtttcaccagtccggccagctcctccaccgccgggatttcctctcttctcccatcgattatctctcttctcaccatatcaatcacctcgcgcagcgtctccacaactacctgccgcggcattatttccgtaaaaaaaataagatgctcatcctgcagcatctcatcaattttagggagttttctcagtaattcctgattttttcccatcattatcactccttctgccccggatatggtttgaacggaggaggtgggaatcgaacccacccgggaggctcttaaccccccacaacggttttgaagaccgcgaggcacaccagcaacctatctgcctccatatcctttaacagtcctaacaacaggcccattgggctgtcattatactatcatgtattaaattgtatgtcaattctcatatttgaatcaggcccggatcctgcctctgttactgttcacaccatgccaaaaagcggcatgctgtaaacaataacacgcttcgcgatgcacagaaactgcaaaaaacgcagtttcgcgccgtgaaactcgggattttcggagggcactgtcctgtgctgtttccagacagtatccctctctccctccggctctcatccgatgtatccggcttctttcagcgcggcaactgctttatcatgctccgcctccgccataagcacgatcggaccggtgcagcccattccgctttccgcatatattccggctttccacagcgtttttaccgcatcctccagatccatcacttcaatgcccgggatctgggcggtgcaaattaccttgggcggcatttttacattatctgaagctgctccctctttaccggaagcattcagttctttcagaatttcctgaaggccggcctgatttgctcttgaaaattctccggcggcaatttccttccatccccggctcaccagattcgcggcaaactccaccgctccggctataaccggcgctcccgaggccctggagacaatcagaatcagacggccgtaaccgggaccgattcccggcccgtagccaaagcccagagactcataacttcctccggatgtataggcggacagaagttttaccatcaggtttccggtgagagaatccataaccatgatatccggcgttccgcagagcagatcattgccgcgcatcacaatgccgccgtccgaccttgccgaatctgcaaagcggatatcatatccgccttcttttaatcttaacagggcgcgctccgcctgtctggctccgtcaacattggcgattcccaccgttggcgattcaattccgtcggcttttgcggcaatcaccccatagactgcatttttaaccatgccgcacacacggtcggtatcggaaatgccggttgtggccgccagatacatgggttttcctcttgcaggagtcaccaccttacctaccgtggcaactccgacaggaaacggatagtgcatcgtcaccgcgccgtctatctctcctgcatccagcatctcctccattttcctgtggatatctccaccttcaatcagtattgctttatttcctgctctttcgataagacgcattgcctcatctatattttccctgccatgctcactgccttccgaagcgaagccaatcaccggctttttgccataccgccccgtttccagagcatccgccacctcaagaaaggtctctgcgatcatcgccttgatttttctttcagacatagtttctccctttcctatggctccgctgattcctcttcccccatcagaccttctgcaaacgtcctcatggcccggcctatcagggcttttatccggctttcatcgatggcctcttctttcccggaccctgccgaaccgtcgttagcctgaaccacaaatgacactccgtcgaagaggttcgtcattctgcccaggaaaaggctgcctttaccgataatcatggcacggctgatttctccgccaagcatctcatcgcgcattgctcccagatatggtatcccggacggaatatggccctgggtcggcgcccagccggtcatcccgtgttcctttacgaaggacttgatttcgctccgctccagttcgcccttcttaacgcccagcgcggcgatcattttatagtttgcctccggcacgtctccggcgccggccggctttgtgatatcgggattctgcatctcgggggcatatttgtcaatatccggaatcttcagtcccgctttctcaaggggcgccgtcaccagagacgaaatgacattctgcggcgctgaacctgttccgatggtatgatatccaactatatccgtacaaagctgcggattgacgccgtcgtcagcgctcagcagcgctgaaaatccggcaatggcatcctccagaacgggaagtccttttttcacatgatccttggcattcattcctagctttgcggtgcagcctcccgcggtcactaccacatttttgaatgttcctgcctgcaccaatgccgctgcgtgcaggagtgcgtgggcaggccctgcacaaaagcccctgacatcgcttcctgttgcattgacgaaaccggcaatttccgccgccgcttttgcaaagttcccgccgcctctctgattcatatcgccgcatgcttcctcgcagcagtctataacgtaatccacagagtcaggggcaacccctgctttgtgaaccagctccagaagggagaggacattcgaggcttttgtcacaagattttccagcatcacatgggctgacaggtttacatccacgtcatgtgctcttttaacggctccgacaagcacattgttgtgatacagtccctctgcatgctctttttccaccaattcgtgtatataatctgatgagttgtcatttttatctaaaaccgccagctgttcctctgtaaaaagcttctgtttttccagctttttcttcactccggcggcaaactcccgttcaagcattaccagttcaaatgcgtcacagatttggattaatccataaaattcatcctgcggcattatctgcccatatctgccttcgcgaaccgctccgctccattttttatcgtaataaggaaattccgtggcagctaaatcagccggttttgcattcccgatgtacacctgattcggtatgtaattcactgcatcctcaaagcttctcaaatgtcccggaagttcttttaaatactctgaatccggatttactaccctctccgtcgtctgtgtcgtcccattatgtaacaccatatcgggcgtgattgccagtgtatagctggcgccttttataaccggatacccattcatgtttttaccttcacctcgttaaatttggaagaaagctgtggagaatccgggaattgatacctgacggtttcctatattcttcaggataccgattctccggattctgtatcagcctctcacggattacaggtatttacaaaattcctcacggatggtggtcatttctttcgtaatgtcatcgacatccaaaaccatctccatcatgctgatctgttcatcgtaaacaccttcgtcaacctctgacttaactccatcttcacaaatgtgataaacacgtagtcccaactggactcctgctaaaggacctgcgaatgtgggatcacctgcggttacggtttcagcagcaagacctgccgcctctccttctgccgcgccgagaacgactactatgttctcaggaccgtactggtctgcataatccttaattcttttttgattctccagatccatagcacccgcgctcgttcagacaaagcattcggtagatgaataaactacgtcagcgcctgccgtcttcacgcattctgctatggcagggcccggaatgccgtcgcggtcgccaattataacgacctttttgtctttcaaaattgccatatgcgttcctccttacctgtttttaaagttccaaccggaaccatccatctataacaacgctcctgaacggggcggctgttaccttaaacttctaattgtccgcctgtaaattagctttaatcattgcctcgatattctccggtgttgcctcttctttgacgcattcctggatttttaatccatccttataaacggcaatgaccggaagtcccagcactttctggccgatagccagcctgcgtgctttcgtcgtattcagcgaagtgaatttcatctgttttccataggtgtcctccatcgcatgaacatgcggcatcagcgcctgacagggagcgcatccgtctccgtagaaatcgacgagaaccggtccttttgctttcagcacctcttcctcaaagtcgtccttggttaaatctaccatggtgttacctccttcttataatcggcctgtcaataaacatggccgtccagttcagcgatatatttttctgcctgcatagcggcaattgcgccgtccgaagctgccgtcactacctggcggaaactcttgacccggacatctccggcggcatagacaccggaaatgccggtgcgcatgtcttcgtccgtcttgatatatcctttttccatgtcaaggagcccttcaaacaattcgcttctcggcacgttgccgatgaatccgaataagccaaacataccgtcatccggatccgcatccactctcgtaagttcccctgtcttcacatttctgaccgtcatcccggacaggattccgtccccgtgaagctcttccaccacactgtcccacatgaaattcatcttagggttcctgaatgccttctcctggatggattttgccgcgcgaagctcattcctgcggtgtattacggtaacctttctggcaaatttggtcaggtatatggcttcttccacagcggaatcgcctccgcccacaacaaatacctctaaatcttcaaagaaattggcgtcacaggtcgcacagaaggaaacgccctttcctacaaattcgccctcccgcctgcatccaatcggccgcgcgtaagctccggtggcaattatcagtgcccggcactgatatgtgtcctttttaccgtacagcttcttgacaggcccctcgagttccacccggtcaatcgtatcgcatgcacgctccgcgccgaatctggccgcctgtctggtcatacggtcaatcagggaagggccgctttccccctccacaatctgccccggataattctcaatttcatctgtaatggcaatctgcccgccgtccctggctttttcgataatcagcgtggacaggcggtatctgccggaataaagtcctgccgcaagtccgccgggacctgcgccgagtatgattacatcataaattttgtccatctgttatgctcctcttacttcttccactcaaaaacggtctgctccgtcacaggggtctgcagggcctcgagtgccttcccgacaatctgtctgcggatatccatctcttcctcatgagtcagggccggattgccgagaggatgggggatcgcaacagccggaacaatccggttcgctccaaccgtcagggaaatcggtacgaccgtggcaatatgaaccaccggaataccataagcttcaattgctttaaccatcgttgcaccgcaacgagtacaggtccctcaggtggaggtcaggatcacggcgtccacatggtcgtcaaccagcttctgtccgatttccttcgcatatttcgtagcgttggcaacgcttgttccattgccgaccgttgtatagaaatattggtgaaggctcccgatttttccttcctttaaaaattcacgaataatatccaccggcagtacacggtccgcatcctgattggcataggagggatcatatccgccatgggccgtctcataagactcttccgttaaatccgtcacgtcttcgatattataacagccatacttggaggcgctggatgattcaatgtgatccggattcccctttggcacaataccgccggatgtgacaagcgcgattcttgcaaaggccatgttttttatcgccggaccgggctctaccctgtcaaagctgggcatcgggtattccgtcacatactctctgccgtttaatttgttgaccagcatatcgaccgcacggccggctcctgtcttttcctcgaaaaagttgacccggatcccgttcggcatatacccctcttccttcgatgaaccgacgggttcattttttaccagcttaagcgctaaaggagccatcttttttaccgccccgcgcattcctgcggcgctgttttttgtttcacagatgtagaccttattcttatacatatctgcgcccggattctctttatacatgccggttacaaccggaattcccaactgttcttttaccgctgcggcaaccgtgccgcacgccacgccgtaccgcccggcgttgaatgcaggaccacagattacgccgtccggatttttttctctgatcatcccgagaaccgtttccgtagcagtatccacattctcattaaaataggagtcgccgcagattatggtggccacaatctccgcttcctctccgaaggcctgggcaaaagccagtcccggccccattccgccctctctcatctcaggcggataatcggccttttcttcgccgccgatattggcaaagaactgatttatataatgtacaaactttaattttgccattttattcattcctttcaatcattcaggtttgaaagcgcttcgcgctgtctgatattaccgggcgctcaaacggttgaatcccatctcgttggtcgctcccgtgatcacctgcagctccgcttcaatagaaccgtcctctttcaggctgccgtcaaatccgccggcaataatatccgccacttccggataaccaatcaccttgtccattggcggcagggtaatcagcatgttggcattgcctcctgttacgacggcatccgctgccgcatccgcgtcggccagagactgggaagctccatcacgcccggcatattcatcggtgatgataaccgtctttatgccttttgcctcgattttcctgcagttcatgataagatcggtatccggattgccgaacccttcctgggagacaatggccccatcgacgcccagccattcgcacagcttagccgtggcatccgaggaacgcatcttatcggcaaggtacacattctcattggttataatcacacccacaaaattcagtgtttttccatgttcttcaaacaaatgcttgataaccggattgttcagatggtgatacgtagtattcttgtcacaggcagatacacagttgccgctcaaaactgcgccgtccatggtctctgtcggacagagaatcgtgggaagagactgtttcatatccaccccgtacacgtaggtgtcatgcataagtccctggctctggagcatcagtacatacgccactctcggaagatccggatacagcctgatgccctccttgacggacggtgtttcatatgtttccacagtttcggccgtgatgtcttttgccagtttccctatgtaatcggcagttttcaagcctgccatgcgcactgccttctcatgagcgtgcttttcgatcccctcaattggttcacacacaacaaccagattgtgaagctgcgaaaacggagtgtactgcgctccggttccgctcatgtcaataatcccctcctgaaaacctacaatcttgccggccgtgaccacgccgcagccgcgcagcacattggttctgccgctccccacagtggctactttagaaatgatacccgggaatagtccgccgtccccgcttgtttttactctcggctcaatcacgtccttaaccggcataatacggatactgtcccccggatgtgcaacttccagctccaccgacttcaaattcccgtcctccagcagaattgctttcaattcttctttattcacagtaaccgtgccgccctctaccctggattcagatccgaaccggatatccctgattggaataattcctaattcaagcttcatctttccactcctccttctttctccctaagccggatccacactcccattcggcttataaaagaattttactgattcactctaaatataagcaatttccatgccaaaaaagagcagccccccgcaagcttttaaaaaccatattccgggaccgccttcctgctcacggcagagggaattttgacatctaccattctgtcaattggcaacgatttgtcaacattgtcattttcgtgcagcaagaaaaaaagaccggcctgaatggatccatttttcaggccggtctttcccttttcttctgtttttcttctaaatgcggctgactgcactttcaatcagcgactgatcgatatagcggaaatccttcttcaatttttcatcccactcgggcagcggtttctccataagaaacttgcggcaggtcataatgctgttctccatcactgtaataaattcctgaaattcctccggatccacctttccgtcggatatcatcaccgtcttgtatggattttggttcggtttgatgctgcctgccatcggatgtgtctccaggcggctccctccgtgaatcgcgtccctcgcctttatcaaaacatccagacagcccgcatcctccagatattccacgttcagtaccttcccgtatgcgccgtagcgctcttttaccaattcattgtttgtaataagcgtatacaatttattcaatgtcctcccctctttccctatcagcgtatccgccggcaactatcctctatcgtatcagaattcattctattcttccaccggaattttatatttctgcggatcatcctccccgctttcctccctccgccttgccatcccacatcccctgtgatatactatgagcacttagcgaggtgttttctaacagaacaaaggaggtatacgcatggcagatatattattgacatctatgacagcgcaccgcggctgagcggccaaaataggccctgatgccctggcacaagttttgtgccatttacccaaatttaatgatccgaatctgctggtaggctttcaaaccagcgacgacgcggccgtctaccggataagcgatgaactggccttaatccagactgtcgatatattcccgccgatagtagatgatccttattcttacggcaaaactgccgccgccaatgcactcagcgacgtgtacgccatgggcggaagacccaagctcgccatgaacgtattctgtttcccggagacgcttcccaagtctgcggtacaggctatattgcagggcggttatgaaaaagtacaggaagcggatgccatcatctgcggcggacacacgatccaggatcctgttccgaaatacggtctgagcgtaaccggcttcgttcatccggatcgcatactgcgcaataacaccattcagcagggagatgttctgattctcaccaaagcgctgggaaccggaatcctcacaactgcatggaaaggcagccttttaaccgtcccacagcagagggagcttctctcttccatggcaatgctgaaccggtatgctgcacaaaccatggagcatttctccgatatccacgcctgcacggatgtaacgggtttcggcctgttaggacatgcatatgagatggcggccggcagtaatctgagtattgcaattgattccatggccctccccgccctggacggagctgtcgatgcagccgccatgggactggtaccggcaggagcttacaaaaacagggagtatttagataagctggtcaatataggcccttctgttcctgattcattatcggatttaatgttcgatccccagacctcgggaggtctgttgatctctgttcccgaaaaaaccggtatcgaacttgtaaaacggctgaacgaaaagtgtccggccgcaagaataatcggacaggtggagacattggataagtatccgctgactgtcttataaatcaaattcaagccgtaaggcaggccgccgtgaagttgcagaagcaatataacggcggcctgttttacattttgcttaatcggacaatactaaaaagacaaaataaccgcaagtaaaatcaagcggcacactctccggatccttataatgattacagggtggttgaaagaggagaagaaacacatgtacgaatggcagaaacaaatacaggtaattgttgatgaaattgacaactgcattaaacactataatgatgaagcgctgaccctgcgtttcctttcccaaaggctgggctattccgaatattacacaacaaggaaattcaaagaaatatcgggcatgcagttccgcgactatctgcgtcacaggaaattggcctttgcgttaaaagaagtccgggacagcaggaaaagtctgctggatatcgcctttgattacggtttttcatcacatgaagcatttacgcgggcattcaaaggaacctatggcatcactccgagcgagtaccgcaaaaaaccgacgccggtcgttcttcgtacaaaaataaactccttcgaccgctactttttaggattcggagagattggcatgataaaatccacggacgatgttaaaatttattttgtaaccattcccgcacacaaatttctgcacattaaaaactatgaaagcaacggatattgggatttctggcaaaagcagagtctcattccggggcaggactgtgaaaccatttgcggcttactcgacagtattaaaggcaagctggacgacgacggcggaagtgaatccaacagcagcagcggccagcttatggcctatatcaacgatccggaaggcaggctctgcgattggggctttcctcgcaccgagtgttatggcgtacgccttcccatggattatcaaggtgaaattccgcctcaaatgctcatggccgatatcccggaagctgagtatatggtttttgaacacgggccctttgattatgagcaggaaaaccgcagcgtagaagatctcgttgaaaaagccatggctgatttcgatttcaccggcaccggatactgttacgacaccactccgggcagaatcatttatttctatcatgatccggagcggttttggaaatatatccggccggtcagaaaggtataacgataacctgcacgctccgcgcacaggttaccgccatcaatcggcaaaaagaggatttcatgcaataacctgcaagaaatcctcttttatcattcatctgttttccatctgtcttccgttttacatcttgcggcagttcccgttaatcttcccagtaatcaggctcaatcggctcgcgtgccagtgacttcccatcatcactctgctcgtccacctgaataatctgtccggaggaattcgtcttatacttggttccgctggaatctttaacggtagtggattttacaattttacccgaggtactgacgagataaaccttattgtcgatcttgatggcctcatacttggttccgctttccgccttctgaagcttgcccatatagaacaggtaattatctttgacaccggtataaccgcgcccagctttggttcctgattcggtgaaatagaaatcgctcttggtaccgtctccctcttccaccgtgcccttccctttcacaacagagcttgttgccttgttgccaaagtaatagcaggcatattcatcggtatttccgattctaagtcgtctcagtccgtaaaccggattccccttctcgttaaacagatatgtaatcccgttgattcttactaaatcgctggtcgatgcctcttctgccggcggccctaccttaggaataccgctgctggagaaatagtaccactccacttcattccccaaatccatatccagatcattgtcttccggcggagttgacgagtaccaccctgtctgcactttgccgttctcctggaaaaagcggtaattttcaaagcttccatcggccttatcccccatgttcacccagccggtctgcattgcccccgtctcgctgaaacagtaataaacgccgtctatcttatatagtttataatctccgctgctgatattcggcacatacttcttgccggagctttggaaataataccagtgcttgtcctcatcatcctcaaaaggcactgtcttatcatcaaaggaatctttatcttccggatcctgtaaatactgccagcccgtacgcattgccccgtcggaacctgtataatacgtatcgtcgtccacccagcccgtctgcattacaccgtcactgtcaaaataatagtacttattatcaatctttgaccagccgtccgttattatcttgccgctgttgctgaagtaataccagaccatcgtattctcttcatcccagcccggattcttcttctgcagcttcagccacttatttgtgaccataatgccgttattatccacgtaatattcatcatcagcccaggaatttactgccataaccccctgagagttcaggtaacgccagagaccgtcggctcccttcttccattcattcgttaccttataattattagaatcataatagacccagtctgtccctgactgctgccatcctgccgcatatgcggtcagcgtcgccgtccccagcgccagcatcatggagagggtaaaaacagtgattcctctcttcctcatataaattcctcccattgtatacaatactctaccatacattctatcaggggaaggaaaaatgttcaagaagaattatctttcaatttgattacgatttaaataacgcaaataaaacgtgatgtacaaccggtgttttacacttcctcatccaacagttcaattgttttgtatagaacatccacaccattttccagttctttttcttccgtccactcttctttacaatgacttaacccatccttgctgggaacgaaaatcatcccgacaggcaggcaatgggccattggattcgcatcatgtccggctccgctcggcatgataatgtgtttcatctccagttcggcagccgcccggccaatcaccttcattaaatgctcatcgcatttaacggatcctttatctatctgctttgtgatctcaaactctaccgtatcaatttttgcggcaatgttacgaatctcatctatcagcctgtccgtcatgtccttgtccatatgacgcatttcaaatatgcattcaacccggcccggaataacattttcagagcctggccagcaccggatcgtacctacagtcagtacaagggcattatcaatctcccgacattttgcatcggcctgaacgatcagctttgccatagccgtcagggcatcacgccgcttttgcatcatggttgttcctgcatggttgctgtgtccgacggctatcactttatatcgcactatccccacaattccgctcacaacaccaatttccatttcatcgttaaacagacgatctccctgctcaatatgaagctccaaataacatttagcatccgaaaaattgcgtttgcagtttagaatctcctgcaccgtatgaccatatgttttcagagcctcactaagccctggctgccccggttctaccaatcctgcaacagctcggctgccaaatgtgcctccaagaggattggactcttcaccgttaaagccatacagctccaacgaatgatttaatgtttttccttcctctttcatgcggcgtatcacctcgagtcctccggcaacgccatatgctccgtcaaacagtccgccggaaggaaccgtatccaaatgtgagcccataataatacttcccagttttttatctttccccggcaatacgcccaggatgttgcctgccgcatcacggctcacttccattcccaactcctccatctggcgctccacaatatccaggccgtcaaaataggccggactgtaacagccgcgggaataagagccgtcgctatttctgcctgccctgccgatttccgacaagatatctcctatatgattcatgaatgtcatcctttccacattgtttcatttcaaaagtaactgttccctccacaggcatttcttttatcccatggctgaacagttactttgagattgataccggtatttatgcctttaaaacaggtttgataaattttccccagcctgccgcactttcatccacatcaccattttccatcaccacccggccgcgtacaaccgtatagtcaatggagcagccgagtttccatccctcataaacttttgagatatctttagcctgagaatagctgtcccgggcgtggcaaattacctcccgcttcatgtccaccacgaccaaatctccatctgcaccggcagaaatcgttcctttttgcggaaagatattgaagcatttggcaggattgacacagcaaagctcaactaccttctccagactgagacgcccttttttggcctctgtcagcatcagcggaaggcgcagatcaatacctggaaaaccggccggagctacaaaaatatcatcgttgcctttttccttctccgaaacgagaaacggactgtgatcgctgccgataaaatccaccgtaccgtccagcacatatttccacagcccttccacctcctctttcttcctgagggcagggttgcattttgcatacgggccatatttttcgacatagctttcatccagaagcagatagtgcggacaggtttccacataaaccttctgcccttcctcctttgcctgtttcgccagttccatagctccgcatgttgaaacatgaaccagttctatcgggcatcccgtctcttttccaaatcggagcattttcgcaattgcctcgatttcagtaataggagggcgggaatcacaatgtgccagataatcggttcgcccctcttctctaagccgtttgatatttcccgtgaccagttcattatcttccgcatgggcagccaacgtgaggcctgtctttttcacttcttccagagcacgcataagctgggcattattcgcgcttgtcaggcctttaaactcagcatcccgtccttccggcgcttcgtggaggaaggttttataagctaccactccctcatgcgacaatggctctatctcttcaggaaattcgccgccggccgctccgaaaaagcagaagtcgacacagctcccttttttgcagagattcacgcggttgtgaagaatttcaggattgtattgaggtggaatggaaatagggtgctcaaaaaaagtggtacatccgccagccgcagcggctctcgtccctacctggaatgtctcccgctccgcatggcccggatcacggtaatgaacatgcgtgtcaatgccgccgggaagcacgtgcctgccatccgcatctatcgttttaaggctttccggaagacagccaggctctgtaaccatagcaattttaccgttgctgattccaacatcggcttttcgaaaaccgccttctatgaaaaccaatccgtttataaccgcaagctctaatttcattgtatctcttcccctttcattcatcacaaattttcctttttacacctgttatactgaacgaggccggaagccagtattaatgcacaggccaccccgtccagcaccgggattcccagttcgcgctcaatatagccatccgcattcgcataattggcacatcccagcacgatcacatcaacaccaaattcttccttcgcttccctggctgcaatcagcagatcttccctgcttccgcttttcgtaaccttaattgtcctcagcagatcgtcacagcggtacttatgggccagggcaatttttttggatatggaatttggggaaggggagatgactgcatagccgttacccatggccgcccctatccttaatgaggcttccgcaatcccaactaccggttttcccgctatttcccgaaccagttccagattcgggtcagagtgacaggctactatataagcatcgtaaatatctgttgtcgtacggatcagctgaatcatttcctccgcagaaccggcctgttcttcgtaagaacataccagttttggagcccttgtcacatgaacaacgtccacttccactccgtcaagcgacagattctttgccttttcctccataatagcgtctgtgttttcatcactattcggattgatgataagaattttcattgtatctctcccgttccgatataaagtatcctgctattttgtgtatgcctcccaaacctccggtgaaacctttgcctctacactcgcccattccggagcaacggcctctttgaacactgctctctgttcatcggtaagctccgtgatcgtacagccatattcctctatttcctttgtccaggccgcttcgttatcaagggcgtagctggtagctgcctcacaggcgacggctataccgtcatccaacagctttttattttcatcagacaagctgtcatagaagctttggctcaccagccactgctgtgtctgctgtaagtggttcgtcttggtgatatcggactgctgttcataaaacttctgggaataaataagctcaatcggattctcctgggcgtctattgtcttctgctgtaaagcggtgtacagttcactgaaagaaaacggcgtgggagttgcacccatacactgccatccctcaatatgcagatcattttgcatgaccctgaatgtcaggcctttcagagcgtccggacttgtgagcggcttattggcagtcgccacgcggaagccgtgaacgctataaccgcccagatagaagcctgctgcggaatatttctcccgcataacgttcaggaaattttcatcctccatatactttttctttacatcctctatgttattaaagttataaaacaaatcgtagataacaccgtcattcacataatttacaataatcgaatttgcaaggcacatctccaggtttccgctctgcaccatctggcacagttcatcatcattacccattgaattatttggatatatattaacagtaaaagcaccattggaattcttctccatgtagtcctttaatgccaggcaccctacctgctgagctgtactttccgctcctccgtggcctatattaatggtaatagtttctcctgaagcggaagcgctctcctgtcctctggccttctgtccggaatcaccagtagaggctgagctgccgcaagcagctaaattaaaagaaagtgccagggtcaagacagctataaaatattttttcatcattttcctccttgatcgcaggggcagtagctcattcccctcttctgaacggtaattatcaggaatccgtgggagttatccccctttttgtgtaaatattccagaacttattgcttatcccaataaattcggtaaaaacatcgtaatctgcggtatataggtaatcatcatcaatgccagtaaaaacatggcaataaaaggcaatgcgtgcttggcaatccgcgtgattggaatctgtgtcagtgaattggctacaaacagatttgtaccaataggcggcgtcacaaatccgattgccaggttaaccgtcataaggacaccgaaatgaatcggatctacgccgtattgctgtacaatcggcagcatgattggtgacaaaatcagaatacagggaactgtatccatgaccatgcctgcaaaaagtaaaaatatattgataaccagcagtacaacaattttactctgcacatgtccaaccacataagctgccagggtctgcggaagattcagaatcgtaagcacacgtccaaatacaatgcagacggacaggatgagcataactggagtcgcggtacgggccgtgtcgatcagacaggttgacaatgttttcaagttgatggccctgtatacaaaaacacctaccaacagtgcgtacacgacggaaacgcaggctgcttcagtggggctgacaatcccgccatatattcctcccaaaataataactggagccagtagcgcgaaaaaactttctttaaaaatattgataaaaccttttttccgaagtgtttttgtgttctgcgcaatttgaagacagctgttgtcgcggcgtgaaaaatagtagataatgtaagcaatcaggcacagggcaattaaaattcccggagcaaagcctgcaataaataaatcgcctattgaagcgcctgttgcaagtccataggtgatgaaaggtatgctgggagggataataacccccagacctcccgacacagcaatcatggcggtaacaaaatctctctcataccccagccttgttaacagcggaatgcacattgttccaatggctgccactgtcgcaggaccggaaccgcagatcgctccataaaacagacaggtgataaccacggcaatcgggagtcccgctgctatattcccaaaaaaataagagaaaaaatcgaacagacggttcgacataccgctttcagccataatactcgatgaaagcataaaaagaggtattgccagcagtacgtaggaatccatgccatttaccatggtcttgaaaaaatattccgcatcacaggtaaatgccggattcatcagatgaaccgacagggtggcccagcccacgctgaatgcaatgggaattcccaacgccaaaaacagtgcgaagataataaacataatgccaatcatacttctttccctccttctgttttcgctctgtttttcgctgtcggaaaccgaaagcggcaataaaatttctgaatgattcggatcacgctgatacacagccccataaacagggcgccatacacaaatatcataggaagatgcagccctgcggaagtttgatttctctctgctatctgccgcatagagttaaatgcggcagggagcagataaaggataaataatgctcctgccagatcctgtataagactgaataccggaatcaccttcggacagagaacctcaataatatttacccgtatatgcgtattattccgaatcccatagctgattccaataaaaacaaaccagatgaacatataccttgtcgcttcttccgaccatgtgagcggagcccgcattacatagcgaaaaaacacatgcaatgtcatcagaacaacaactccgcacagaaaaaatgccatcaacatctcctcaaaatgctgatccagccatcgcagcgttgttttcatatcctattccccctctcctgccgggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactacctcctgccggacatatcatacaaaacaaaaaccgctgcctccaagaacccgatccaaactgccgcatgcagaaagcggtacgtattttccggacacgcctccttccgaaaagctggaaacgcgaatctcaaaatcaatcccatccccgacgagatgaatcacatgggtatttgtgtcaaccgtcggatctgctgtaatcttagaacgggtacggtcaaagccgatcccggcaagagcgacagcagcatgaacattcacatttctcggaaacagttccgtagctttccttgttgttccttcatagagaaccgtgagtttcgtatcatcgcgtcccaggcttttgggatttttaattgtttcaacacttacttcccgcagagcgtcacggccgtcaaagattccgtccagaccaaggatcgccccatgcggcaaaaatacattggtgccaaatttatcacaaagttcctttgccctctctttcaggctgtcgtcgcgaaaagcagtcatggaaaacggcatgatactgcagcacggcagaatatcttcgagatgctcggtaagaacctttgcttcagcacattcaaccaccagatcgagcccctggaagatattcgccggtatctcatccaccactttaacgccgcagacttctgtttcttttataaacggatcatatacaaattctatctcaccgttctttttctcccttacatgttcaatcatcgctctgccgattttcccgccgcctaaaaatgcgattttcatcatatctgtttcctcctttatttctgtttacggtaccgttccataatctgaagcagccgttctattccggcaaccgccttgtctttatcctgggaaaaattaatacggaactgccagatacatttcggatcgaattccgtgccaggagtcactgtcacatcagccatctctcggacaatcctgataaaatgatgaagtgatatatctaattcaggaatcctgataaataaatagcttccgccttctgccggtcttgcataaacccccggtacgcccgccaatttttccataattgcatcatgtatttccttatgctttgctgtcctggccgtcatccagccttccggctcattaaaccaggtggtaaatacagcctgattatatccgctgcacctcagggacataatagcctggagcttttccatacgttcaatcatttcggcatttccaaacgccgcccccagccggtatccgctcagtgattccgtcttcgacggccccataatggtaaccaaattctccggtatttctttctgagcgcaaaggtgtgtataggttattcccggataaatctgacgcgaataaagctcatccactatcaacgtaacatcatacttttttgccagcgaagctatttcgcagatttcttcataagaataaatgcaccccaccggattattagggttagagaagataaatagctttactccgtcaataaataccttttccagtatctctaaatcaattcctgctctgtcggtcctgttttcataatgcatcgggacgggaacgagtacaccatggaagaattccaccatcttacggtttgcaaaataatccggctccacaatagccaccttgtcgcccggcagaatattgctgcctgccgcaagaaataaagccccctgtgttccaggtgtcaaaatcagattctcgtccgggttaatctgaacccctgtaaaggctgataggctggatgcaacatgttccaatatgcttttttttccacggtaaggcgtataggcctgggaaccaccctgggcaaacccctttgcaaatatttcaagactgcccggaaccggctcatgcgcgtcgacatctccatgtgagaaatccaccgctgctcccggaagcttctccccacgtatttccaatgctgctgatttctgtaaactctcctgccctggagcattatcaattccaagttttgaaaacttttccgctattgtcataattcatttcctcctgtttatcacccccactgtgtcacggccgtttgagcagggtttttcactcttttggtatcactttgtaccttaatccgatcatagcattggggcgatatattgtccaatagacagggggatatactttcatgtcagaaatggaatagactcatcccggcatcggtgtattttttagatgttcaataaacagcttctgtaatgcagtacactcctcatctctgtaataaacgctcaggttgcgggttgtatccggatggttaattttatagaataccaattcctccgacgggcctatgtaatagggaatactggctcggataaaggtaattcccgaaccggccccggcaagatagcaggcgctgaggagctgatccatttccatgacgatattcggttcaaaacctgcgtcccggcagattttaagccccctgcggtgcatatcgttgcctcttttcagaaacaggaaattctcttttgcaaaccattccatctgtacccccgggatttccggcatcagaaaacggccgctgcatatgtcttcatatccaatggcataggataggagctcccggttaatcgccaggctgctgggaaccgctaagatgatattctctttttggagtacaaaggatttaaagttagaaggcatggttggctctacggaaaatcccagatccaccattccggccttgagaaatttgcataaatcactgtcattgctttctatcatcttgattgcaataccaggatattccattttaaaagcattgatcaggggaggaagcacatatgtgcagaaaaaagatggcgctccgatattcagatcgcattttctgtggcggcgcagttcatcgcaatacccctctatctcaagatgaatctcctgcatcttcctgaagtagtcgacaaatacttccccttcgggcgtcaccttcagaggaaccgaactccggtcaaagatttgtgcgccaagattcccctctacccgttttacaattttgctgagcgccggctgcgaaatataatacttttccgctgcccgggaaaagcttcgctcttcacatacgcccaggatatacagcatatcccttacttcgactggttccattctttttcctccgattgtattatttgacagggtgatttatcgcccttatcttttctattgtatcagaaagaattgcaacagttcaatactatcttgcaatagttcagacagtagactggggagcttcttttggtgatttagttaagcaggtgaggacgccgccggtacggccagcggacggggtggtggggtgtggatatgagtctttcgtcccgggggaggattgttgtggtttggggctgcgggcgaagataaagtctgcggagcacgctcccgctctgtgaaatgcatcgcgctgctaagctcggcaggacctcgctaatcagcgatggatttcaacggcatccgcagactttatcttcccctccgccccaaggccaggttatcgctgggacgaaagactccgccaggggtatcggcaccgtccgccgttctgcggccgctgatagtctcacgcgttaagtgcggggggcggaccttgtcgaggccactcagtgctaccgtgtacgaaaaatacgatatgccttcaatacgccttttataaaaattgtggaggatttgatttcagcctgccggaaacacatagtggctgcgacagggccctccccatttaaggttagagacaatcagcgcccggaacggaccatgttcggtgttgcacaaatctccgcctgagtcttccgcccctggcgaaaacctgaccgggggaaggaggcggaatcaattctggaggggacatggaagcccatccgtgcttaatgaggttttttcgaatttagcacggctatgcgcttcgaagagtgcaaacggtccccgtaagaattcattccgaccggattcccccctcacgacaaccttcaaccagggatggaagactcagccatccccctcaccacaccggacatggtccgttccggacgcgtcctcctaacctccgttaaatctccatttcacccccggttccatttgacacccctattctgaccatatataatagataagaagttgggatattctgcggatatcccgcatacatcatgcatttttaacggtaaaggcaggctctgctgacctttaccgccaattaacgataacctgcatgctccgcgtacaggtcaccgccatcaataaaaggcagaatccggctatcagaaaataccggacacttctgcccctcagaaaggatagattatattatgtggattgccgacggctggaacgattacgaagtaatagactgctcccagggggagaagctggaacgctggggagactacctgctggtccgccccgatccccaggtaatctgggatacccccaagaaacacagaggctggaagaagatgaacggccattatcacagaagctccaagggcggaggcgaatgggaattcttcgatctgccggaacagtggacaatcgactataaaggcctcacctttaacctgaagccattcagcttcaaacacaccggccttttcccggagcaggccgccaactgggactggtttggaaataagatacggaaagccggaaggcctgtaaaggtcttaaacctctttgcctacacgggaggtgccacgctggccgccgcgaaagcaggagccgctgtcacgcatgttgacgcctccaagggcatggtaaactgggcaaaagaaaacgcccgctcatccggcctcggggatgccccgattcgctggattgtggacgactgcgtcaaatttgcagagagggaaatacgccgcggcaaccattacgacggtatcatcatggatcccccctcctacggaagaggaccaaaaggcgaaatatggaagatcgaagaagcgattcacccctttgtcaaactgtgcgcacagcttttatcggaggaaccgcttttttaccttattaactcttatactacgggactggctccctccgtgctgacttatatgctgtccacagagctgctgccaaaatataaggggagcgtacgctcagacgagttaggcctgcctgttacggaaagcgggctggtgctgccctgcggcgcttccggccgatgggaatccggcgaacgctaagcactaagcatttactaagcattttttaacggccgccgctcaggagcttccagagcggcggtatttttcttttaaggaattctgaggttccccaggaaagaagaaccgcagcggcggcgactgcaaaatacaggatcagcgccacccccgccgtatggggcagaacaagggaagccgccttgttaatcgtcctgacaatgagaaaatggaacgcatacaggaagaagctctccttcatccagggagccggagccggaagccggcctgagggcagggcaatccagatcgtaaccggagccagcagtccgtaaagcactgccgtcagaaaattggcgtaacggtgtgtcgtcctgaacatcatgatgcagagcaggacacaggccagaaccacggcccacttaagcagccgcgatacagctttatccccgcctcttttttccgccagccgccttccatggagagccagataggcccccgatgagaaataaagcagcgcgtccagattcaaaacgggtatcaccgtggctttgccgagaaaatacaataaaacggcgattgccgctcccccggcccacagattcgacatcaccgcatatacggccggtgcgagcgctatcagaagtataagctgctgcatataccaaagtacagggttataagtataattaataatagcatccgccaaattttccagagaaaaaacaaccattcccttccctgccacggaagacaggacgggaatcctggacacgacgataaacaggaaatagtaaagtgtgttccacacgatgtatggtatcagcacgctcctgaccctgcgcgtcatcttatccggaatctcgccccatgacacatcccggaagaacagataggatgaaatgataaaaaatcccggcacggcaatggaaggcacagcaagagaaaccagagcctgcacctgctttacgctttctgcaaacactccggttccctctccatttatgaataagtctgcgttatagctgtgaatcattacaaccaggcagctcaggataaaagtcatccatgtaatcttatttcgaaattccgcctccgataatcgcttcatatacctgttctctcattttattcttaattattcccggaaagattcagcgctgccgaaacatccagcatgcctccggttgacgttttgcctgacaagctgtccagacggcggaccgaattaaggattctgcccttaatttccgtcaccgcaagaccggaatcataagaatacagcatagcggccgcaccggtcaccatcggcgccgccatggaggtgccgctcatatagctgtatttatttccggaaaccgtactcaggatatagctgccgggcgccgccagatccacgctcttcgcaccgaaattggaggaaggatctatctgtccgtcgaaccttaaattggctaccgaaatcacgttatccaaatcaaagctggcaggataaacagggaggctgtctatattatatcccctgccggaactgtcgccgtttcccgccgctacgataaacagcatgccggaattcttcatcgtctgatataattcctcactgtatttattggttccaaagctcagattacagatcacggccccattgtcctgcgcatagcggattgcctttgccacattatccgccgtgccgataccggcaggtgttcccaatgccttgacactcatcactttgacataggatgggtcacagattcctattattccgctcccatttctcgacgcggcgattgtcccggcagagtgggttccatgatcatcatccggaccggtaaacacctggttattattcgaatagaaattccatccgtaaacatcatccacatatccgtttccgtcattgtcgattccgtcacccggaatctcatcttcattcatccagacagcatctgccaaatcaggatggctgtaatcaattcccgtatcaattacggctacgattacctggcgttttccttctttcgcatcgtatttcttccaggcaggtataatattaatatcaatcccggctaccgccagagttgtcccttcactctccctggcaggccccggcctgttctgtccggcattctggcctccaagccatccctgaaaagtgctctccagtggagttttcgtactcggaaccagcttgaacactccgctgttaagcaaagcccactgataatccccatacgtatcggaatacggcagcgactgatagcccggacccagcgaataaatattcacaccggttttccgatgctccttaccgtgcgccgatgcctccacaatgacgctttgggcgcttcctccataaaatgcagtcagtaccggagcaaccagggccgcactcagcatcaaagccgctattctgttattaagtaaccgtttttgtctgtttttcattgtcactcctgaatttttgcatcatggccgatacttctgagcccgataaatacaacaacacatctcggcggaaccataaactgtttctggttttttagaaccggttcctctccgtgtctgtatataccattattctcattgtcatccgtattaaaggccagatgccacatcatgcccttcggaagtttgggaagggcaaattcatgtggttcccaatgcatattgtatgccgtgtaaaagtaatcatcgggcgcgccgcccgttttttccccatattccccacaatacatgattccaagctggcggcggaaattctcaaattccggacaccaggttttcactccgtgatatgatacatccggatgaccgcagaccaggtaatccgtattcttcggctccgttcccatatgaaaaacagaatgctcttttctaaaagcaatgacgtacttgacgaactcaaaaatatcccggttcgtctcaagcaaattccaattaatccaggagatctcattatcctggcaataggaattattattcccgtttttcgtgctgccaaactcatcccccgcctgaagcaggggtgttccctgacttagaaacagcagtaaaaaggcgtttctcaactgttttctgcgcatctgtactattttcttttttcgtgtcggaccttccacgccacagttccaggtatgattataatccgttccgtcacggttattttcgccattggcttcgttatgtttcatctcataggacaccatgtccatcatggtaaatccattcgtattcgccatataatttataacgccgaagccggcgggatttcttcggtttctgaagatcaatttattaatctgatcctcgtcccccttcagcacactgcgcatatcaaccagaaagccgtcattgtactctcccagatggcgcaccctgccattctccgcattctcccacgatgttgcaaaaagttttgtctcggacagccatggatcacgcaccagcagcccggccggtgcatatccggatagatgcactccatccacatggtactgcataacccagaagcggaccgcctccaaaatcagagacgggttttctttcccggtaaaatacagttcgacaatcagctccagcccgttttggtgaagctccttgaccaggctgcaaaattccgctgccggtctcttatgccctcccgacgaatacgacgctttgggggcaaagtaaaaaccttccccgtatccccagtaattcagccgtcccgtaggctcctggctgcggtaaggattgccgtccgactgatcgggcatcattacttcacaaaactcatttggaggaagcagttcaactgtcgtaatgcccagctctttcatatagggaattttttccgtgattgccttaaacgttcccctgtcggaagtgtgtgaggatgcatgctttgtaaaaccgcggggatgcagcctgtagatcaccatctccccgaaagcgtattttaacggtctgtcgtcttcccagtcaaagtcctccaggacaaagcagcttcttaccggtcttttgacggaagataaatccccccattgttcgcgtccccggaattctctcccataaatatcgggctgttccccgctctccgtctccaggcagtattccagtcccgaaaatccatcgccgcaaagttccatggaccatacatctcccaccttctcctccggagaaaacggtattttctctattattttcccatccctgtaaaccaccaggctgcagctttcgccgggagccacggtgcagatatggattcctttctctgtctttgtaatgcctaaaggaaaatttctgtggccgttctgtattttttccatttcgcctgtcttcacttgtccatctcccatccggcagtcatcttgccgaagttattggttacagctcccacgccgttaaacctgggctgtaacaattattgtgccccaatctgttcagccagctcatttaagtacatccagcgttccatcttttcttccagctgtgcttctttttcctctttctcctgcatcagccggttcagacggctgtaatcactggcagcctggagaatcccgccctccagctcagccacctcttcctccagagcggcgattgtctcctcaatcgtctcccattcccgctgctctttatacgtgaatttcagcttcgtctcccgcggctgcccttccttccagtttttgcggttaggctggctctggtcttccgcccccgctttggcggcggtactctcctcctgcccctgccctctctcttcgagagcagcctgataatcagtgtaaccgccttcatactgttttacggcgccatcgccctcaaatgcaaaaatccggcgcaccaccctgtcgagaaaataccggtcatgggataccgcaatgacgatcccctgaaaatgatccaggtaatcttccagaatcgtaagcgtcctgatgtccagatcattggtcggctcatccaaaagcagaacgttgggcgcccccatcagtatatgaagcaggcagagtcttcttttttcccctcccgaaagtttaccgattaatgtatactgcatactggaaggaaagagaaactgctccagcatctgggaagccgataccattccgtccggcgtcttcacatactctgctacatttttgatatagtcgatcaccttaaggctgtcgtccatctcttcattatcctgagaaaaatatcccatcctgacggtctgtcctataaccgtctcccccgaatcaggctgaaccaggccggcaatcatcttcatcagtgtggatttcccgcttccgttcggcccgataatgccgattctgtcattcttcagaaaaatatatgtgaaatcacggagcaggactttatctccgtaactcttatttaaatgcgagacttccaccgtagttcttccaagacggcttgtaagagaattcatctccacatccccgtcttcctccggtcctttacgtgcgctcagttcttcaaagcgctgaatacggcctttctgtttcgtcgatctggccctggctccgcggcggatccattccagctcggttctcaggatgctccggcgtttgcgctcggaggcctgttccatcgccatacgttcttccttcagttccagatagccgccgtaccctgcctgatagctgtatagttttcccttatccagctccacgatacggtttgacacagagtccagaaaataccggtcatgggtaatcataaggagagcgcctctgaattttttgaggtagtcctccagccagtcggccatgctgctgtcaagatggttggtaggctcatccagcaccaggagatcggccgcagataagagaacgctggccagtgcaaccctctttttctgaccgccggacagcgtggatatcacagcgtcgtactccggcacccccagccgggtcagcatgtttttggcctgtccttccagatcccagacgtgttcatggccttcattctcttttattacacactccagtacggtaagctgaggttcaaatacgggattctggggcagatatctgatatacaggtttcttccccggaccacggttcccagatccggttcttccagccctgctgcaatcttaaggagggtggatttccccgtaccgttgattccaatcaggccgattttatccccctcattaatagaaaatgatgtgtcatcgaaaagaagacgctccgtatacgatttggtcaaatgttctatagtaagtaaattcataatcatctgcttcctgtccgtttaattttccatagttctccgtgtttattgttcgcgcaactgcgcttttcagcagggctttgaatcctaacccccgcgtgctgcgtccgcgctcccgccgggaaacggtaaatcctaccgtatcaccagctccacaggacaatgatccgaacccatgatttcggtgtgaatcatggcgctctccagtctgtcttccagggcttttgacacacagaaataatcaatgcgccatcctgcattcttttcgcgggccttgaaccggtatgaccaccaggagtatattccttcctgatccggataaaaatgtctgtacgtatcaataaatccggactccagaagctgcgtgaatttcccccgctcctcgtcggtaaatccggcattcttcctgttgctctttggattctttaaatcaatttcccggtgggccacattcagatccccgcagaaaatcacaggtttatgctcctccagttttttcagataggagaggaaatcatcctcccactgcatccggtaaggcagtcttgccagcccgtcctgagagtttggcgtgtagcatgtgataacataataatccggaaattcagccgtgatgacacgcccctcgtgatcatgggcttcaattcccagaccataggtcacggacagcggttcttcttttgtaaaaagcgcagtccctgaatatcctttcttctcggcatagctccagtactggtaatatccatccagctccaaatcaatctggcctccctgcagcttgctctcctgaatgcagaaaatatcggcatccagctctttaaaaatatctaaaaaaccttttcccacgcaggcgcgcaggccgtttacgttccaggaaattaattttttcattgcatgtctctcctctatcgttaatttgcatgaagctgccgtgctgccgttcacaggctgtattccgtggggtgttcccgtccgcagacctgtaaaaacagcgtacaatctgttttcagtatatcattttggccgggaatatggaaggggaaaaagaaagaccaggccggataatcgcagccggcctgatctttcctgaatgaaataatttgatttttatctttacaaatctacgctgattttctgtttctcaatcttatggcgctctacatatccggtcaggatcatcgtgagcgctccgtctccggtcacgttgcaggctgttccaaagctgtcctgaagcgcaaagatggtgagcatcagggcggttcccgtagcgtcgaatccaaggactcccgtaatcagacccagagaggccataaccgttcctcccggaacccccggcgctcctaccgcaaaaaccccaagcagtacgcagaataaaatcatggttgaaagttccggcagagtgccgtaaagtacctttgaaaccgtcatgacgaagaatacttcggtaagcaccgatccgcacagatgaatattggcaaacagcggaatgccgaaatctaccatatcgtccctgagagtgggttccgattttctcgcgcactccagtgccactgccagagtggcggctgaagacatcgtgccgacggccgtaatataggccggcccgtaatttttcacgacattcaccggatttttacctgaatatgcgccgcccagacaatagaggagcgtcatccagagatagtgcccggccataacaataatgattaccttgacaaagacagggaactgcttcgtaatggagccctcgtatgccagggaacagaatgtgaatgcaatataaatcggcagtatcggaataatgattttcttaacgacatcaagcacaattttctggaattcatccagcagcttcgtaacggtaactgccttcgtccatgtggcggccaggccaatcattactgagaataccagggcgctcataactcccataacaggcggaatggagagctggaatacaacttccggcaattctttcaggccttccacggccggattgatagacatgccgggaatcagcgcataacctgccgccattgagaacagagcggctcccagtgatgatgtgtatgccagtacaagggcaattccaagcattctggaggcattcttccccagtttcgtaatcgatggagcaataaatccgataattatcagcggtacacagaaggaaatcacctgacccataatatagttcagagtcacaacaacatgcatcagcccttcattcgccaccagtcctgccagaataccgatgacgacacctaacagcagtctgacaggcagacttttaaaaactttattcataaatccttcctttccttgccgccataagcgacaatctcccccttttccggcgttctccgcaccggttgtttagaacattgtatttccattatatcaatatttatgccgaatgcaattaatttgttattattaccaccgcgttactgttcaggtaggtctttgttactaaagcatatggagatttaacggaggttaggaggacgcgtccggaacggaccatgtccggtgtggtgaggaggctggctgagtcttccgtccccgggtggaggttgtcgtgagaggggaatccggccggaatggattgctgcggggaccgtttgcactctttggagtgcgcagcagtgctaagctcgtgagggacctcgctaagcaccggcggactcccatgtcccctccgcaattgattccgcctacttcccctgggcaggttatcgccggggacggaagactcaggcggaggttttcgcggcaccggacatggtccgttccggccgctgattgtctccaaccttaaatggggaggaccttgtcgcggccactgcgtgtttacggcaggccgatatcaaatcctccacaattttttataaaaggcgtattaaaggcatatcgtattttccgcacacggaagcactgagtggtctcgacaaggtccgcccccgcacttaacgcgtgagacactcagcggccgcaggccagtggacggggccgatacacttggcggagtctttcgtcccggcgaaaaccttccgggagaaggagatactgccgacatcttccggcggagaaggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtaaccccggggggctttgccttcctctggcttagagctatccctcgaagaagcagtccagccggatatcattctctccggctccgccctgcgaaaacaaaaccacagtatctccttctccagccagcgatgccaaccccccgggacgaaagactcatatacacaccccaccaccccgtccgctggccgtaccggcggcgtcctcacctgcttaactaaatccccattttaaaatctaacagcttgtatgtttctgtagttttttgtataataaaagaattaaaataatcggtaaaaagccatattatttaatgtataattttttttgagaaggagcatacattatgaatcgaataaaattcagattatacccggtgttgatggcctcggctctgtttctggctctggcgccgggaggggtttcccaggcacaggcgtcaactatatatacaccgaaggccgacggcaccgtggtctacaccagcgcaaaagccgtgatcgacgcctcccacacatccgacggatatgtgatggtcaaatacaccggttctaatcccaaggtaaaactccggatccagaaggataccgaatacacctatgatataaccgcttccggcgattatgtgacctttccgctgaccgagggaagcggaagttatacggttaaggtattcgagaatgtatccggcacttcctacgcacaggccgtgagccagacgatacaggtgaatattgcaagcgatacaacaccatttttatatcccaaccagttttgtaactttaacgccgattctaatgttgtcactgtcagcgataccatcacgtccggtatgaccgatccgctgaaaaaggtggaagccatttacaattacgccgttgacaacatcacatacgacaaccaaaaggctgcgaccgtacagtccggttatcttcccaatgtggatacaacgctggcccagaaaaaaggaatctgttttgactacgcggcagttatgacctcgatgctccgcgcacagggcattccgaccaagcttgtcatcggttatgcaggcaatgtataccatgcatgggtgagcgtatatattcaggggcagggctgggttgataatatcatctatttcgacggaactgactggaaattaatggaccccacttttgtatccagcggaaagaaaagcgctgaagtcctgaactatgtcagcaatccggcaaattacagacagaaattctgttattgataaacaggaggtattactatgagccgcggcgcatcatcaccgtttacaggcctggcactgtccgggttctgcatgcagatctcgattcttctggaatctgcaattcctctctacgagggactgaaagttatggctgaagattcccccgtacaacgggaaaaagaaatccttacggaactgtccgacaaagtccgcatgggactgccgtttcatcaggcagtccgggaagccggctgttttccggcatacgtcgtcaacatgtccatgctgggggaacggaccggcctgctggataccacaatggaacggctggccgtttactatgaaaaagaatattatcttgctgagaacctcagaaaagccgttacctacccggcgatgatgattcttatgctgattattatcctgttcgtcctctttaccagggttatgccggtattttccggcgtttacgagcagcttggaacatccattcctcctgccgctgccgccgctatccgcctggggggcatattaagcggagctgccctggttcttgcagcgattctcatcgcctcagccctgattttatggcttttcggaaaaaaaggagtccaatccaccctggcactctcccttctggagaaaatcaaagcgcgttctgtcatcgcccgcgctgccgctgaccggagattctgcaatgtgatggccatgtccctccaatgcggcgtcaatctgccggatgcattcggcctggcgcaaactctggtggataaccggactgttgaagaacaaatcaaaaatgccaaagaagccgtctctcagggtaaaggcttctacgattcagtcaaagaagccggactgttttccggattcgagctgcagttgatccgtgtgggcagccgcgccggacagctggaccgcatcatggaccgtcttgcaatagattacgagcaaaagtcttccgaggccattgactctatgatagcgcgcctggaacctacaattgtatcggttctggccgttgcggtcggcctggtccttctcgccgtgatgctgcctctggcaggtgttctgtcctccatcggataaggagtaacagttcagccatgatgttttccgcgaggtgttttcgctgtttcttgcgaaaatcccgagttgtgcggcgcgaaacgacgttttttgctgtttctgtgcatcatttgttacggtttagccgaaggctgaaccaatgtcatttgattaacaatgcaataaattggagatttaacggaggttaggaggacgcgtccggaacggaccatgtccggtgtggtgagggagatggctgagtcttccgtccccgtgggaagttggttgtggagggggaatccggccggaatgaattgctgcggggaccgtttgcactctttggagtgcgcatcggagtgctaagctcgaaaagacctcgctaagcaccggcggactcccatgtcccctccgcaattgattccgcctacttccccgggtcagtttttcaccggggacggaacactcaggcggaggttttcgacaccggacatggtccgttccgggcgctgattgtctccaaccttaaatggggagggccctgtcgcggccactacgtgtttctggcaaactgaaatcaaactttccgcaattatataaaaatggcattgaaggcatatcgaatttcccgttcacggaagctcttagtgcccgcgacaaggtccgccccgcacttaacgcgtgagacattcagtggccgcaggccagtggacggggccgatacacttggcggagtctttcgtcccggcgaatacttgaccttggggcggaggggaagataaagtctgcggatgccgttgaaatccatcgctgattagcgaggttctgccgagcttagcagcgcgatgcatttcacagagcgggagcgtgctccgcagactttatcttcgcccgcagccccaaaccacgacaatctccccccgggacgaaagactcatatacacccccaccaccccgtccgctggccgtaccggcggcgtcctcacctgcttaactaaatcttcatagtgttcactaaatgacattgaaggcgcaactgtaacgataaggagtgtatatctatgttacatattgaaattccaaaacacaggagttccctgcccggatatctgttttcatttctcctcctcattattgtcctgtatctcttcctttattccatgggagccatgcagagcaggacaaaagaggatcagttaaatatgctgacggatgccatccgcagggccagcgtccagtgctattccattgaaggccgttatccgcccagcgttgaatatctggaagataattacggcattgtaattgaccgcgaacgctataatgtgttctacgacggctgggccgccaacattatgccagatatcacggttctgcccgtgaccgggcaggcaaaacagggagggcagctatgaaaaagactgtatcgcgtccctcggaaggcatggattttatcttttccatgctgctgtttcttgtatttattctatgctccgtcttcactattctgattggcagccgcgtatacggcaatatccgcgccagaaacgacgcagctttttactcagactccgcattgagctatatcacgaacaaagtacgccagtccgatcggaccggcagcatcagtgtccggacggttgaagggcaaagcatcctggtgctggcctccgattacgacggcatcctgtatgaaacctgggtttacacaaaagacggcacactgctggagctgttttccgagcagggaagcggcctcaccgtagaagacggccttcctattatggactgtgagcccatttccttctccattgccgataagaagaacggagcgatgcttgagattaccctggaggaaactccttcccccagaactgccagcctctttcttcgcagcagttcgaaaggaggccgcaggaatgaataaaaaacggacatcttatgcttttctgatggaaatgctgtgggtatgtggttttttcgcagtggctgcctgtattttcgtacttgcgtttgcaaaggccgaccggctcagccagaatgcggaaaacttaaaccacgccgttctcgccgccgagaacgcaattgaaactgcttttgccgaatatgacgaagcgtctgcccccagtgagacacattccggttttgacagatattggaagatatgtgaaccgtccgatccggaagctgcctattttatgaaaattaattcatacgcggcagaaggactgcttcacgtatctgtggagatcagcgatatcagaggaaaaggaatggaaactatctataccttgagcggcgcccgaagtctggccgctgaaaggaggcttccatgaaaaacagaatcaatataggcacagcctccattatccttatttttatcatcctctgcctcgccgttttctctctcctgagtctgagcgatgggaattcggcccttgtactggccagacgccgtgcagattcggtaaccgcctactaccaggccgatgccataggccaggagttcatccaggctgccgtctcggctcttgacggtaacaaaagcatggaggaggccctttctgatgcagcttcactgatgcctgaaggaacggagtcaggagttgatgaggcaggcaggctctactgtgaaataccgatgaatgccggccaggctctccgaattgaactggatggcagtagcagggaggttctggcaagctatgtctacaatcgggaagattatgcgatagacgacagccttcccgtatggatcgcccctgatgaataatgaagaacaaggtttgaaaggagatataccatgcttaagtttttgactgacgccgtggagaaaaatgcatcagacatttttataatccccggcctttctctctcctataaaataaatggtaagattattccagtcgacgataataaactgatgcccgccgattcggaggctctgatcactgcgctttatgagctcagcaaccacagaagtatggataagctgcatacctacggggatgacgatctttcctgttctattaaaggagtcgccagattccgcgtgagtatcatgaaacagagaggctccctggccgccgtcatccgtgttgttcactttgagatacccagaccggaagatatgaacatccctccggaagtcatccggacggcaaacctgaaaaaagggcttgtccttgtcaccggagccgcaggcagcggaaaatccaccactctggcatgtattatcgatgaaataaacaggacgagaaacagccacattattactttggaggatccgattgaatatctgcaccggcataaccgttccgttgtcacccagcgtgagattggactggatacggacagttatgtaaatggactggtggcttccctccggcaggctcccgatgtcatcctgctcggcgagatgagggatttcgatacgattaaaaccgcgatgaccgccgcggaaaccggccatttggtgatttcaaccctgcataccatcgggtccgccaattcgattgaccgtatcatcgatgtattccctcccgacgggcagcagcagatacgcgtccagctggctatggttctccaggccgtcatctcccagcagctcgtccctaccgtcaccggaagcatggtgcccgcctttgagatcatgttcctgaatgatgcaatccgcacaatggttcgggagggcaagattcatcagatagataatgtaatcgccaccagtatggccgagggcatgatcagcatgaataacagcctgctgcggcttatgcgggaaggcaaaatatcccgtgacacctgtatcagctacagcagtgatccggaacagatgcagatgcgcttaatgtaaagccggaatcacgtaaaaaacggtgagaagtccgcaacgcggatttctcaccgttttttacgtgccacgaccagcagtctgccgtcttttagtgtgtattcacaggtggtcagtgtaataagctgctgaggccattcggccgtaattcccgtatcataggcagcatgtttttttatgtactgtacaaagctttcgtattcttcccgtgttctggctgccagcactgccgcaaatccgctgctcagcttctcggccggaagtctgacaactcccactatctcatataccgatgacgaatcgggtgtatccagacaaatttccggatgttccttataatattcctcagaaccgtatttttccagtgaggcaaacatggttccgtttttcatgtgatgtccgtaaatgacgcagttgggacttgccttcccttcctctgcctccgcttcgtaaagcgcttcatcctcccggagccggcaggccgcgtccatataaatcatcccatatgcggaatatctgccgtcaaatcccctcctgtagtaataatccggaatgtccggggtttgcattaccgggtaatcaatgggtgttcccgtaatcgtgatccatgccgccacatcctgattgatctccttcagaagcctgcagccttcccggcgctcctgcgccgactcatattctgccgctctcagggaggcctcatccagccggctcttctcgtttattgtaagagcgggcgatattgctccgcgtatttccattaccgccgcaatatctctttcactgtggcggtactctttttgtgtttttacatacataactgtaaaaaccgccatggagatgaggctgagtgtaaatacggccgtacacagccgtcgtttcatcttgtcggtcataaatcactttttccctccggtatactttttccggcggattaatgcggtgcagcctgtcagaatcgaaatcagcatgcctgttgcatatgccccggctcccatatcccccattttgggaagagagggcaaagctgccagcggcaccggttcatcccctatctcctccaactgcggatctgcggaaaactggacagcggcgtattgctgtcaatgattaccgtagtatttcccctgtcccggtcatggccgcccgatgaaccgcctgagccggttgatggaggctgcgacggctgtgaagcgctgccggtttccccggttgattcctccgcagaagatgtgggcggagcttccgtcgagggtttatccgtctcttccgttgacggcgcttctgttgacggcgtctccgttgacggcgtctccgttgacggcgcctctgtttcaggcggttgttccacttccagtttcggagctgccgtcacctcatatttcatgaccatttttccgccttcgtccaccatcatgggcagtgctgcaaaaaatggcatcgacttcactatcctgtccgtcccgggtgtaccggtctggcttacaaggtacaggccccgttcgagaccgcctatctttgccctcccatttttatcggtcacttcgctgccagctgcttttatcttattctcagagacaaaagcagctgattttaccgcatttttctgcatggctgattggcttgaatcattcaggccgtcaatgtccagtccggaagccgcaaagtctcctgtcaggataaatactccgtcctgcggcatttcagccacctgatagacagaccactcaacacctgctattcccgtcccatctgaggatgcctgtattgtaagcgcggccttctcactctccgccggcacagcagccgcagtctgtactgcaaatgccgccgcgagtattgcagtgatgagaatgatgagaaatgtgtctgccttctttgcaattcctttatgtttcatcgcgtttccctcttttctcctctaccttttctcccccttcaccggatgtgtatggcggccattgcttcctgcgaagtcccatcggaggttacctcataaggaatccttaccccacgcaccagaagccggtggctgttaatcccatacggcgtgcaggtaaacagtgtcatatattccctgcccggcaccggatcgagcagttcctgctgtgtcggaagaaccgtttctatctgatctatctgataagccataatccggttaaatatgtggaaataaaatatgtcccccttctccatctcttccaaatccgtaaaaagcctggcggacggcagccccctgtgtgccgatatgacgctgtgtgtcccgctcccgcctgtaggaagggctgaaccatataaatggcccgcccctttcttcaatacctccgccgatgtgccgtgataaaccggcaggtaaacatcaatttttggaatatctatatagcccatcactccgtttatattcagcagggcattatactcctcatcttcttccgaaggatcagcgcctcccgtccggaagggatccatcgaaagtgcgccggataaccggctgttatatacttcagcccttgcaagcatttcctcttcctgcgttttactcagctcccggacccccttttgataccccttgatatcggacgccgccgctgcctggtaatacatattgctgatgtccggataaaagtacattccggctccggcaagcagtaccaggacggccaatatgataattccttttctcttcatccgtctctccttgtcacaggaaccggctctgtttaacgtcttcttttctgcgccttctccctgacaaacctcctgtaaagcagccgatcagaacgaacagcgacgcaagcatcattccggctccctttctgcggagatggtcggttcccgcacctcctgtttccggcaggaaaaagctgcttcttgtatttgtgaaggtacaggaatagctcttaccgtccgagggatttttcaatacggcagacggaggattctcgggatcgaagagggtgtcctctccggcgccgccgccgaattccctgacagacacataatatccgtcgccgtctctctcggtaatccggtaattccggccggccagaaccgtaaatttcgcagtctgaccattggtcagggtaaattccccattctccgcagttttcccgtctgatgcggtttcaccggttcccggcataagctgatagggctgcccgcctgcgctcacccatttcccggtattggccccgtcttctttctctagacggaaggtaaatgcctgagccttatcttcctcaaaccggctttcaatctttttcgttaccgcaagggacgccgttggtatccggacgcctactttggccggctccacggtgatagtcgacttatttgtggagttgacggccctgtatgcgtatccgaatgtgttccacgcaaccggctcattgctcagatccagttctgatgccttcggaagcaatgcgctgaaggttactataaccgtatcattgttcgtaagtccttttaacgcgtcattttccacctcgatgcggaaggtgtctctgcctgcggcggaggactcccaatcggacgcgctgtccggttcccaatatcgtgcaggcaatgcggagcctttgccgaatttcgtgttccagtccgcaaacgtgacattataatctccgtctttaagtcttaccatttgtccggacgctttcctgatccggacttcgattgcaggcgagtcgggaaatgatactttgaaacctgaatttcgctgcatgttgtttacaagtccgttatccttcaatgccggaagacgatccactattaccaggttttcaatccccttttctacctgattcctgatgttgagcgtatacgtaacttcgcttccggcatcggcaataattgaattgcgggagctgtcggtgccggtgccggtcccctctgttccgttgaaggagcctctgatttctttccacgcctccgtctttccgtcaccgaagaaaatattgaccgatgcctccgcacggacacagacaggctgattgccctctttgaccagcgtgccttcacaggcagccgtataactgtattcccgggccggtattaaatcagcctggttcacataagttccatatttagccgttccgtcgccgtcagccctggaacctattctgactgtaattttgccttttaccggaatggccaggttttcattcgtcttcacggtatggccgtctgcacccgttatcaggtatccttcagactgtttctcaatcttccaggaggctgtcacattctttccctcttcgcgtccgacagccggttccggaaggggtatctttttcccgcccggggtgacaatataggttccgtccgcatcggcttcgttgtaagtcaggccggccgggaacacatccctgattgtataattttcaatcggccctctagtcatatggccgttggttccattatacagggtcacctgccagcgcatcggattgttcggaaggaaattgtcatttttaccgtccggtttataatcataccagttattcgaagcattgtactgagccaggctctttccgataccgggagtataaattcccgccgcggcgacatcagcggaagcggttataatcttatataagtcatcggaataagattttcctcccactgctccgctcaaatcagaaaccggcctgtcgaatgcttcatccgtaatcgccgtctggtcaacaatgacaccggtagtattagtaagtttcttaataccgtcaagatctcccgtgacctttgcaattattccgtataccacacttccgcccggtttaaccgatggaacgggggacaaacctgtctttatggcatccgtatcgtaaagccggacacggtaagttgtcttaccgctgttcatcgatgcaaaatttgctccatggctcaccgccacctctgcatccgttccccatttacctgcggccgcgtcttcataatacagccagtttttaccggaaaacttattgcttctttctttaatccccagatccagcgtatcgctgtctcctactgccccaggtatcttctttccccggtccgcaccgttgaattcataaaaccgttcaaactgcattccggcgggcagccagtcttcgatttcatagatgcggagaggttcttcatcactttcgttattaatggtgatccggtagaaaacataatctccttttccgacagtgagagtcgtttcgtcttccgccagtcctgttccgctgccaagaaccggattattccatttggcgcccttcagatagacatggcccccttcttctttcagctccctggcgaccgcgtatacctctttatcaatcgaggccttctggacatcctcgttaattgtaattgaggcggacgccctgatcgcaaatttccgctccggttccttatcataggccagagaagcgctgaccgtattttcggggaacagaaccgatgctccctccggtatctcaagatagatacggaaaacaatactttccccctttgccagttccacgttctcatccaatgcctttgtcccgctctggccgggtgtcagactgagccagcccttagctcccggtttcttcataaatacagatcccggttcacccaaatccgcgtttgcataaatcgggcggattccgtctccgaacaggtttgatatgtcgtccgagacattagccttaaacctgtcattacccgtatttttaagcgtcatctcataacataccacgtctccggcccggaacgtaacgctctgatcgacaggatggcgcctgctgttctgctctgtaatactgcccttttccgatgctccgataaaataagctttcttctcaatcgatgctccgattgcataaagagttgcgctacccggcttatcgaagccctctccttctccgcctcctgcatgagcctggttggtaatctcgccttcggcctcaatcctcccctttaatttaatattctccgtcacacccggtttgagatagactcttgcttccacggtaattccggatttccctgcaagcgagaacgcgctccaggaagccgcgctgtttcccttattctcatagcgtttaatctccatcccattctcttttatgatgataattgcctgtgaaggaatattggagatttcctttaacgttacggagccgggccattcgtcttttaccgtgatccagtgggaattgtgtacgcctccggttaatcccgccatgagattatatgtcacgtcgctgcccactgccggctggctgccgcctgttccggcatttacgatagtcttcctgaatgtgacatcgctctcttgtaaagtattcaggttcacgaataccgtcgcatcatccctgccaaggcttttttctctctgcacatctgaactgcggtaccatccggctgaattggtctgcgtcgtattgatgttattaccggaatctcatttccagtccggagtttccccctcctgtgacagttcgggattcaacattttgaccagggactctaccgaataactgagttccccttttgctccttcggtttgcttccatctgtcaagacacctggtaaatgctttgttgcagttctctttctctgttccgaccagaataatcatatactggctcttgctgtaggtggtgaacagatctcctcttctgaacgatgaccggattacctccttcaggatctccatctgcgtctccagcttctccgaatccgttatctccttccccatccgctcggtcaggttcagaagcatcaggaaaatagatcttccgcttctctctgccactctcgcaagcagctggcaagagtcaagaaagctgggatacaggcagtaataggcgcccgtattcttctgctccctgaagttttcttttaaatcatcaaaattccctaccggattcttaatctgactctctatcctgcgcagacggcttaccatctcaggcccgggcggcacgcccagctcctcgcaatagagtttggccgtattccgatagacgtcatatgcctctttatactccttcagcagcatcagacagtcaatctcctgaatctgccatttatcaaagggatataatttgccggctttccggtaaagccgaagctcttcctgatactcgccggcctgtcggagatattcccccagctccaccacagcctgctgatacattcccttaagctgcagattccgctcaatgacccatagctccgtagaaaattccggcagcaattcacccgtatacagccgttccgccgttcttaaaaaaccgatgcgcccggcgcctgccgattcctttgccatgctgatgcattcggtaaaacggacggcatctgtttctaccggaaaactgctgctccagcggcatatgccgctttcgagaacaacatattcctcttccggcagtccggctaaaacaagctgctttttcagcctgtagataacattattcaaattcttgttgggatttaccccggcattccagccatagagcgtatctatcaattcttttttggaaatcccctggtcggcatgaaggaacagcaaaagcagaagctgaataaatttcatattactgcttcttgaaaatgcaatcttttttcctgcataagtcatcgaaaatccgctgaacatattcacgctcagaatttcctgcattcccggactataaatctgctcttccattcagctccccctttccggacagacagtaacttttataagagtatctctattataatacattttccgagtattaccatcttttttatcgtaagctttggtaaagtattgctgttcacaggtcaccgcattcagtaaaaagccggcgggcagagctttgccctgtccgccggctttcacatcctgattgaaggcggtgactgttgtttcaattaggaacgtgtcagtgcagtttctgaccggctggaatatttcccgacaaccgcgttcatctcatcccactttttctccatgtcggccacaagggcaaactgggtatggcagcgttcaagattatgcttctctctgcttattttgaagtatacgtcgccctggagataatccgtaagaaagcggactccgcattcatacgtcataagctttgctcccattgggagcatctgcacctcttcttttgtcaggctcccattgcagccgtccatatatcccttcgtataaatatcgaacagcggcagtgataatcctgccagtgaaacgtcctgttcatcttcggccgcagtgttggctccaaaacggatagaatcaccaaagtcaaagattgacagcccgggcataatcgtatcgagatcaataatacacagcgcctctcccgtcgagtcgtcaatcatgatattattaagctttgtatcgttatgggtaacgcgaagcggaagcctgccttctttcagcatatccatcgccactcctgcctccccggcccgttccagaacaaactcaatttctttccggacagaagcggcgcggccgcatacatcttcctccaccgcctttttcagcgttgccagacgtaccggagtattatggaaattcggaatcgtctcatatagttcatccgccggatactgggataactgcctctgaaaacggccaaatgctttcgcgctctgataaaaatcttccggtttcactactttatcataacaggttgcattgccgatgaacaaataggagcgccaatattggccgtcactgtccacataatagtccctgccgttcttagccggcaccaggttcagggtctccctcagcggatcccctccctccttctcaatctccctcctgagaaagcttgtgacaccggtgatgttcttcatcagtgatacagggtccttaaaaacttcacgattcatccgctgcagaatgtaggcgtgtctcccgtcctccgccatcgtactgacgtaaaatgtgtcgttgatatgtccgtggccgtaacggtaatattcctccgccgcaccttcatagctcatattagctatggcctcttctgtcttcagtatcttgctaaccatctatctgtcctcccagagtttctcggggtaaattcctgcatctttcataccctggatggcatccattaccatttgtttgtcttctttgtaggtgacgccgtaccagcggtcgggagtatttaaaaccgttacctcagccctgttttcttttaacagttcatctacgacaaatgggagaaaatattcgcacttaaccgggttcacaggaagatttgcttccaggaacggaacaaatctggcttccagctccgtcagaatgctctttgtaaatccccacatattcatggaaacgatggttccatgaggaagatatacccaggtttttccgtcgtcctcggtatactccgctctgccgccatgattttcaattctggttctctcctgaatatccaccagcctgtgattctcatccgtactgcagatgcccctggccacatggccgttttccgttattgaattatacagctcatagcctaccatggtatactgatatttctcatcgtcgccatgggaagccagctggttataaatttcacggaatgccgttttgccataataatcgtctgcattgataacggcaaaggggccgtcaatcacatccttgcagcacagcaccgcgtgccccgttccccacggttttacccggccctccggtacttcatatccgtccggcagcacatccgtctcctggtaaacatactcaacctcaacgtgcttttccatgcggcggccgatatgctctttgaaatctttctctatcgctttctttataatgaacacgactttttcaaatccggcttcaactgcatcgtagattgaaaagtcaattatcaggtctccctcccggtctaccggatcgatttgcttcaaaccgccgtatctgctgcccattccggctgccataattactaataccggttttttttccatattattaatacatcctttcacttgaatttgccatagagcgtgtttgaaaattgctttccgtcagatgtacgtcacactttgtgggagatttagtccgaatgagcgctgcgtagtgggctacggcaagcgaattcgggccaaatataccgcgaagcggggcgtgcagatggcgggaatgaattttcaaacacgctctggtcacggttcccggccccggcgaaaaacgcggttccgcgaacgggaacaatccgccttaacctttgacaccgccgcctgttacgccggcaataatcttctcagagaggaagatataaagtatgaaggtcggcaggaatacaataataaccgccgcaaacataccggcccagtcgcccgtatacttcatggaattgatcatggagtacagtcctaccgcaacaggacggatccggtcggagtttccgaaaataagggatataaagtattcgttccatacattgataaaattaaaaattgtaacagtgatgatacccggctgtgccatcggcagcataatcagccagaacgttttcgtgggtgaacacccgtcaatagccgccgcctcttcaaatgccctcgatatattggcaaagaaggtcagaagaaaaatcgttgtatacggcacattaattcccacatacaaaaatatcagtaccagccggttagacaattcgtggttcagaagatccatgcccgccacaaggccgaacagagggagcacaatcataacaaccggaacgcccatggccgatacaaaaccggtctgtattactttattgctgataaacttaaaacgtgacagaacgtatgcggccggagcacaaatcagaatcagcagcgtacaggagatgatcgaatatcccagcgaattcatgaaaaaggtggaaacatttgagttattccatgcctttgcataattttccaaatgaaaaccgctggacataatctttcctgagaaaatcgcctttgttgttgaaaagctggcgcccaccacccagcccagtaatacaacggtaaataaaatccagagacaaagaatcaggtagccgggggcaagtttcagttctctgttccagttaacgcgttcgcgcactttcttttctttcgccataacttcccctccttttagaattccagatcatcatctttcagcagatggttgcacagccagaagatgagaacaacgcagacactcagcataacgccgactgccgcaccgagaccggagttacgctccgtcacactgttgccggcgccgaagatctgcatatacagataaaccatcggagtgatcgtctgattatccgccgtaacggaggagaacagctgcgaccacacgaaaaatcctacggaagttacgctccacatggtaatattcgtcttaaatacgccctttaaaagaggcagtgttatgtagcggaactggcccagcttattagctccgtccagagtcgccgcttcgtaataatcttcgctgatacgctcaataccgctggcgaaaatcagcatatggtatcctaccataccaaaacagtaggcaaacaaaagagcataaaatttgtgatcactgtccagccattgaatcttggccagtgatgtcagtcccagctttttaaagactcccgacaaaaggccgtactggttattgtacacatactggagccacatcgtcgccagagccaccgcactgaccacgttcggcaggtaaatcatagctctgaaaaaactcttgaaacggattccgctggtgaggataaccgcaaataagagcgccagagacataacgatgatccctccgataaaccagatgcggaacaggttccacatagaggttttaaacagtgtggtattcataagtttaacataattgtcaattccggtaaactgccacttcgaaaatgaatccgtgattccttctattttaaagaagctcatcacaacggtccggcagatggggtacaggaataccataataaacataaataatgccggagccaggaaagtgacaatcattgctttattcttcttcaagccgtttcccccttttatctttttttagaatttctataaaaacatggtgacagcgatgaattttatcgatgccaccatgtaattcttcatttcagtagtctttcattcaagcgcggacgcttctactccgttatgaattgtatttttagtttttatttctttaatgcatcgacaaattcctgagctgaaatgctgccgccaaccagtttaagcatgttttctttgatgattggtgtcatgtctgcattatcttctgcgcctgctgcccaaggataacgaactgtgagctgttccataaccggctgtgcacactgtaccattgccggccactctgtattggttgtatctgccgggataccattgctctcttcagccagaacctggtcaaattcacccttggtaatcttgcagattaactggaacgctgcctctgcattcttggaattcttgttgatggcgaatacctgagcgccgtagttggatgcgtttgttccgtctactccgccttcaactgccggatagctgaagcatccccatttgaagtcgtcgcctgccatagcctgaacttcgttcggaagccaggagccgtttaagtacatagctgccgttccgcctgccagttccatgttctgacctgccggccatacgttggaagcgatattctcggagaagtagcctttctttgcgaaatctgcaaaagcttctgctgtcttaagaactgccgggtcatcccattcgccgttcttaacaatctcggatgttctctcatatcctaccagacggcacatatgataaccgaataagcaggtgatgtatgcgtcgtcatctgtaatcggaacatatccggcctctttaatctttgcacaagccgcatccagctcttcccatgtagtcggaactgccgtaacaccggcttcgtcaaaaattgactggttgtagaacattgcaaatacgtttggctggtaaggaatggattttaatgttccgtcgcctacctcacggcatgcgccaatcagtcctgcattagccgtcgcctcatagtcggctgcctttgccaaatcttccagatctaataagtactgtccccatgtcttgttgacacggtcgatatcttcgtcaaataaatcgatgttggttcccgcgtcaagagccggctgtaaaccttcacgaataccggtacgtcccttgaactgtgcgtctaccttgatgcctgtctctgctgtgaaggcatcgattgctttctggatagcctgcccctgcggttccgtggactcccacattgaccagtaaaccagtgttccgccttcggccggagctgctgtctccccgcctgcttcaccgcctgcctcctgggttgctgccggagctgtttcagccggagcctctgtcttgctgccgcagcctgcgagcatggaaactgccatagccgccgtcagaagtacgcttaatgttctttttttcataaaatcttcctccttaacacttttagtgaattttcacatttagtgcaattcatatctctatgatattatactaattgccaaatttctttatacaaaacgtttccttttttgcacttttagttcttttattctttacatggagcaatctgtggtttaaaatgtaaaaaatgataattaacagttcaggccaataaccgatccactttttcgaaagagcagcagtcaaaacagcaatcacagtcaggaggcggcatgtcttaccagtttaccgaattaaaggaggagctgatcatcaagaagatcgtgagcctccactacttcgaatatatgagtgattttaccttccccggcgagtcccataatttctgggaatttctttatgtggataagggggaactccaggtaacggcagatcgtgagaaattcattttgagacagggccagattatctttcaccgccccaatgagttccacgcactggccgccaataatgttatcgcgccgaaccttgtggtcatctcctttgaagcgggtgaaccctgcatggctttctttgagcataagatactgactgtcggagaaagtgaacgcaatcttctttctcagattattgccgaggcccgtgagaccttcgacggaccgatggatgatccctatatggaagttctgagccgcagggaaagtatccccttcggggcagaacagatgatcaaaatccatctggagcagtttttaatccagttgttccgcaacttctcaggcacgctcgctttcggggagaaccataagctaaacggcgctcacgctcccggaaagtctccggcgctggcagacggaaatgaactgttctccgacatcctggattaccttgacagaaatataggaaagtcgcttacggtagaaaaaatatgccgggataatctgatcggcgtgtcccagcttaagaaattattccgcacctaccagggtagcggcgtgatggaatgcttcaaccagatgaaaataaacgcggccaaacagatgattcgtaaccagcagatgaattttacccagattgcggatgcgctcggctacacctcggttcattatttttcaagacagttcaaaaagctcacagacatgacgccgaccgaataccgagcgtcgattatgctgagggcaaagagaccgcagcgaaaacatttatagggcggtactgtccagttatacggttttttgcgggaaattattatcttgattggaaatgagtttttcgatttgatttcgagttgatttagattttatgtcaattcagccggtttcccaaaggatataaccggccggggctaattcttctttttccgatccagttcatgcattctttttacctgactgtataccaattccttatcacgttcattaaggcctctgtaaagctggaccagttcatggattttaatggagtcttccggctgaaccagatcggaaattcccagcatgtagtcagcagaaacattgaaataaacggtaagacgtatcaaagtttcaatcgacattgataatttatctttttcaacgcggctgaccgtctgctgagatgttcctatctcatcagccagctgctcctgtattaagttacgccttttgcgtaactcctttaatttgccatctgcctttaataaatcttccactgacgttttctttcccattgcacacctctgaagttattatatcaggtatgcttttcccatatacctaaattatgggtacatcaatacccatattatgggtatatattccttgagtaagaataccgctcgagggattctctgcctgcgtagggcgcttcggctgcataattgcctgccgccgcagttcagtcactttatcgccatacttccttagccccagtgaacgtcaaaattcccggaataacggcaagtttattccgggaatttattttaccgcattacggcgctttggccgacccatgcggtatggagggccattgccgtacaggaaagccgtacagggccgcagaaccggtcagtaaagcttgctgagtccaatcttgcgttccacaatatagattactacccctgcaacgataataaacagggttgcaaaagccgatatgagcggggtgaacgactcagttatataagaataaagacggagcgggaaggttactgtcttagcgctcttcatgaacatgataataacgcattcgtcaaaggcgacgacaaaggagaatacggctccgccgatgattccctggcggatacatggaagcgtgaccttgaacaaagtcctgaccggcgaagcgccaagtaccagggaagcctcctcgaatccggtatcaagtcccaccagattggccgtgacggttctgatgacatagggaatttctatgatcgcataagtcaggcacaacttccaatagttcgtgaacatatttccgaaaatggcaaagtactgcaaaaatgcaacggcgctgatgatagtcggaatgacgattggcgataaaaaaatcgtctcaaaaatcccttttaccctgctgccggacttccagaaccagaggctcaccatcgttcccagtacgcaggctataacaacgctgacgcaggctatctttacgctcaaaatcaaagagctcaggaattccgtgttggcaaaggctctcccgaaccatttgagcgtaaatccccggggcgggaaaataactctgttcgtatcactgaaggccgtacagatcactacacagagagggcagagcaaaaacatatatacaagagttctgaataccttccccgcaattttagtaaaattcatcttattccccctctctgcgaagctcatctctcaatattctggaagaacgttccgcccttttttcacagtaaatatcatacagttttcctgaatttgtaagagccatggatacgatcagaaaaattacggaaatcgcagccgcaaagccccagtcataaatataagttgcctgctggtaaatcagggtggtcatggtgacaattttcccgcttcccagcataaccggcacgacgaaagccgctgtatttaatgcaaatacaagcataaatcctgaaattacgcctttgattgtcagtggaaatgtaattttaaaaaatgtttcccagaaaccggctccgcatacgtacgatgcctcttcaacactttggctcacatttccgattggccctgtcagtatcataatcatgtagggcaggccgcagtagaccagcccaatctcaacggcgagatatgtaccgcactcaatcatcgtcatcagtccgaacattcggaccgtgatcgaaacccagagaggcagcatgaccatggccgtaatgatacttttcttcttcccctgcattctgctgagatgatatgaaataggatatccgaggataacgcagatgattgccgataaaaagctgagtccgaccgtctttccaaggacaccccagtaatatccgtcttttaaaaatttatcatagttggacagggtaaacgctcccagcggtttgttgaccccgttaaaccggaaaaggctcagatagaacattttaaccagcggagcgacaaagaaaaatgtcaggaaagccaggggaataattaagtaccatttattcacataagaccatgtgtctttttctctatccatggaaatacctctctttctgtactttggagatttaactgaggcccggaggacgcgtccggaacgtaccatgtccggtgtggtgcggggccgcgacaaggtccgcccccgcacttaacgtgtgagacactcagcggccgctggcctgcggcggcgtcctcacctgcttatttaaattctttattccatctctcaataagcgccgctttaaccggttccagcgtctcagaatccatataaagcagtttggatacctgttcctggccgtatggcatatattcgcggagttcttccgcaatcacggtttttccgttggaaggagcatagtaattattttccgcataggctttctgtccttccggtgaaatcagttcgtttacaaataaatatgccagttccttctttgtggagcctttacttatggcagccagagatgtcattgcaatagagccttcttccggctggcagaagccgatatcatagccctccttcatcaggccgatggcacggccgtttgtctcaacagacatgacgatgtctccgttgctgagcatgctctcgatatcagagtgttgacttgcataaacaccgatgtttggtttcagggaggatagctttgcaaacagattatcccagttctcttgatctgccaacgtatatccctggatacgtgaaattgcttccgcaaattccagaccgccgcccatgctgtaatcaataacgccgatttttccgcccttgtaggcatcatcccagagatccagccagctcacgggttctttttccacaagatccctgcggtatataataccgtaggtgccccagttcgtcacaaccgccgtgtcatacatatgggcttcctcgtataaatccggcgcgtttgacatcttgctgaaatcgagtgtctccagtacatccatattcgttccctgtacaacttcactgcagtccacgtgaagcacgtcgatggaagccgcatcaccctccgtggccagctgggaaagcggagccgcaccgcttacgacttcaaccttagcccccgtcttcttctcgaaggcaggaattatgtagtttctgagtgtttcttcataagttccgccccagacctggactaccagagtctcaccggaataatctgccgtgcccgtatctttgctttccgtacctgcgtcctgtgtgccggcctccgccgcagacggagcttccgtatcaggggtttttgcgggactttccgaagcgccggaagaaccgcatgctgtcagcatacctgccatcaacagtgccataaccgatttgatttgttttttcatttgttcctctcctctcattctctggtagtgtcaagtctgacactccgttttttattaaaaaccttgtattttcagggattacaccacttttgaaaataaaaaagcaatgacctccccttttctggtataatgagttcaccacaaaccatcacctaaaaaggataaatcattgcttatggataacattatactctatttactcactataattcaagaacaatacaaaactatctgctggctcctgaactttatctgcaaatatattccactcaagcagtgggcctttgatggttcccactcccctaaataccagaagtttactaccgaccccctcccgctcctcaagccgttcatcaaacaggactggcagtttctccttgaatactatctctggaagtacggcaaatccgtcagacccgttcagcgccgcaatggtaaatccatccctgaagataccttctgtcctctttgtggggcacctcaccactatctctacgataataatggcggcaatgggcagttccaatgcaaagtctgtgggcagacctttgtcaccggcgaggttgtcacatcgcctctccgctttgtatgcccttactgcggccactccctcgtccctaataaggaccggaagtttttccgcatccataaatgcgtcaaccccaggtgctccttctaccttcacaacctctccagggttgataaggaccatctgcatgaggattacggtaaaaacaagtataagctgcactacctctaccgggaattcacggtggatttcttccgcatggacttagactccctgcctgagaattcctcctccctgaagttttccaaacataacgctcatatcatgtccctgtgcctcaccatgcatgtgaacctccagctttccctccgtaaaacggctcaggctctgtatgacctttacggaatcaggatctcacatcagcaggtcgccaactatgccagaacggccgccattgtcattaaaccctttgttgaccactatgaatatccaaagtcctccgtctttacggcagatgagacttatatcaaagtccggggcatcaaaggctacatctggttcatcatggatgccgcttcccgctccatcctcggctaccaggtttcagacaaccgctctgtcgggccatgcatcctcgccatgcgcatggctttccggggcataaaaagactccccgagaagtttcggttcattgccgacggctatagtgcttatcctctggccgcccagcagttcgtaagggagttgggagacagcttccagtttgacattacccaggtaatcggactcacaaacaatgatgcggtctctaaggagttccgcccctacaagcagatgatcgaacggcttaaccgcacgtttaaatccacttaccgggtcagctgcggttacgacaattacaatggcgccaactataacgtggcgctctgggtcgcctactacaactttctccgtccccataagcacaaccactatcgggtgctcaatccagtcggtatgctggagggggctgacaacatgcccgggaagtggcagctcctgattctgctcggtcagcagaccatcctccagctgaaggaacagcaggctgccggttaaatctgttcttagattccgggccagaggtaaaaatgcagccatcccgaagggacctgcccttgatggcacgccaaaacaatgctatcatgctgtgacgcagacggtgaaatcttatctgttcctgagttcttcgccgtcggtaagacgttcagagcattgttttggtgtgccgtcaagggtggcggacactgccagtttctaaatatatctgtaatttacaaggttcatttacgccgggttccccggccatcggttttcataaatcacttgacactacccattctctatctttcaaccaggatcagtccattttcgtcgagttccagatatatcatgtcaccctcaacagcccttccctcatccttggtgtgaagatccacttcaaaatcattatttcccgccatttcgatcacatagcgcaaagtcgaacccaaataaatttttgcttttaccgttccggaaagaatattgctcttgtccggtttttcatcatggaggcggatattctccggtcttatgatcaggacagccccatctccggccgccgcctttttaaccggatccgcctttgcccagatttcttcaccgcttgtaagcttaacggcaaatctgtcctccgtagcctttgtcacactgccttccacaatattggcatggcccacgaagccggctatgaaccgggttgcgggacgggtgtaaagactgcttggttccgtgatctgttctatccggcctttattcatgacggctatccggtctgagatggtgagggcctcctcttgatcatgggtaacataaatggccgtgacattcattttcttcagcagattcctgatttccactctcgttttttccctcagcttggcatccagattactcagcggttcgtcaaacagcatcactttcggctctacaatcatggctcttgccagcgacactctctgctgctgaccgccggacagttccttgggcagcctgttttccacaccttcaagctgaactaaattcatcatctcccttgctttctccatcagaaccttcttatctttaatttttctcgtcttcagtccgtaaacaatgttttcatatacactgagatggggaaacagcgcatagttttgaaataccatggagatatcccttttatggggaggaattccgttcatatcacggccctgaatacggatcgttcccctggtcggttcgatcagtccggcaatcatccgcagtgtcgttgttttaccgcagccgctggcaccgagaaaagagacgatttctcctttttctatctgcagatttacgctgtccaccgcaagaaattccttatactgttttgctacatcaattaattcaagttgatagtccatcttttcaccctccggccctgtatcaattatagtctttacagtttcattgtctgaattttcaaacgccctccggcagaaacaaaggctcaggcctgctctagcctgcgggccagctccctgaaaattgcccccagagcgtaggcgcctgcatccggatatccgaggctcctctcacccactgtacctgcccgccccattctggctacaattttctttgtgctttccgccccttcttccgctgcttttgctgcctgcgtaaagatccggagtataggggttccctccgctgccagctgtttccaagtatctgcacagggaaccagggcatcgatcagggtcttgtctccgggaacggcccctcgtccaaaggaacgctctccggtcgcctggattccctgcaccgcctttgcaagcacttctgccatatctgcagcgttcagtgttttctttccttccgccgctttagatgcagcccggaaagccgatccccaaattggcccggaagcaccgccgcagttttccatgataatcagggaacaggcgttcagaaatgaagcgatatcgtctgactccgcaatcacctcttcccattctctttcaagcgccctaaatccttttgccacactcatcccgaaatcgccgtccccagcgtgtgaatctaattcacagaaaggaacttcattttggatgatatatcctcctatacaatctatcataaaaatcatattgtgtagagatatttcttcgtctttgattattcctgttccccggttctttccggttttatccggcgctttgtcacgtaccgttttgcactccggcagcccaaactcttccagttccggttcgccgtctattttgagcgccggagtctgacaaggggcaaacagatattttttaatttcagaatccagcttcaatatcgacagagaggcccccatcatatcaatgctggtcataaaatttcccaccagggtatacgccttcctgattcccctctctgccagcgctttccgtacggaacggttcaggacatataattcctgcatgggcgtccctccaagtccgtttacaaggactgcaatttcttcctcagactgttctgatatcccaagcgcctctaaaagctgcgagaccattctttcggcaactgtgtccgcatcctgctgtttttcccgtctgattcccggttctccatgtatgccgacaccatactccatctcatcctccccgatatcaaatgttggcgttcccttagccggcacggtacaggaggtgaaggcaaaaccgattgattttaccgatgatgccgttctttgggcaatagccttcacttcttccagattacatccggctaatgccgctgcgcctgcaattttatgtacaaagaccgtcccggccaccccgcgccggcccaccgtatagaggctgtcctgcaccgcgatatcgtcatccactttaacatagtccacctgaattccgtcctcgcctgccatatacgccgcatttttaaagttcatcatatctccgctgtagttttttataatcaaaagagtgccttttctgctttttgtctctctgattgcctgatatacctgtatctgggatggagaagcaaaaacatcgccgcagacggctgcatccagcatgccctcccccacaaagccagcatgggcaggttcatggccgcttccaccgccgcttatcaatgtcaccttattctgactcagcttttttctcgttataaaccggtacttttctgagtacagtaattccgggtgtgcaagcgccatcccctgacacatctccgtgacaacctgttccggtctgttgataatcttcttcatgcgtctcctccaatcctttatcctgcggcaccattttatctgttatccgtatagactctgccgaaatattgtttttcttttgctttgcatcatagttgcttgatatttttgtcgatttgtgttgaattatctataaatgtatggtatattatttcaacacattaagcaattgaataattattatggattacattacaaaattgaatgagggtgacagacgatgagtatattgaaatacagcgcatttttgaaggcagtagagtacggcagtctcacaaaagcagcggaagccctggtctatacccagccgggaatcagccatatgatttcctccctggaaaaagagatggggtttcctcttctgatacgcggcaaggatggcgttttcccaacggaaaacgcaaaacctttgatttattacatgcagcagattgtgtctgccgatgaaacgctgaaggaaatttcatgtaaaatccgggggattgaaatcggttccctgagggtgggggctttctacagcgcctccgtcaagtgggtcccgcccattgtctcccgtttttcttcccttcatcccggtgtcaggctgcaggtttttgaaggaaatcattatgatctggaggaatggctgacgaacggtaaaatcgatatcggtctcatgtccatgccggtgcccgaaaattatgactttatcccgctgtataaggatacgatcctcgcggttctccccattgagcatcctttggccggctgtgaaaaggtggatcctgccgatttggtaaaatacccatttattatcccgcacgagggaggcgacgaggatgtctggcaggtaatgaacgcggaaaaactgaaccctgagattaaattccgtatcaagggagatatggctaccctttccatgattggccagaatctgggtgtctccctgattcctgaactggctctgcccttccggttcgataatattgtcaccaagcctctgatccgcgatcattgccggatcctgggccttgccatccgatccattaaacatgcctcccctgctgccgaggagtttatttctattacaaaggaatatcttggaatatgaaatgcaaaaagccgctgctgtgattatgttgatttatcagaaattcaaatattagataagtacccgtggattacaaagtttaaaaaacccgcacataccagtgtgctgataggagggactaaaacggcgttcctgttttcccgtgtgggaatagggaacgccgcctgtctgttaccgttatattatgacgtattacttacagatactgtgcaaaatcctgttttgcaaaaccgttataaacgccccacggtatgatgagatccacccacatatgatggcggttaaaatatttaagcgccgcattactcagatgtacaaactcctccagtgtttcaaccgaatctagcgcttccagatacataaataaaagctcacttgccataggaacaccggtaaacacaaagaattttgctttataatccagtatgcgttttgcaaagtgaatcaatgtgcgcagatccacatccccctctttcgccgtctctatcatataaaaaaggacttcatcacacagtgttctgagttctgaatctgcgtacatcatcgttgtgacatactgtccatatacattcgtatcgcccggcaccttaccgccactcaaatcataaacatcctgcggcatattttcccagattgcaagacgtctctcttcaaatttgtcaatcgctgccttccagttcattatgtgcacctccttattctacttcaccggtaattgtcatcatgctgccctgctttaaccagttcttgattccaacaacctgcatggcctccatcccctctacaatacggccaatgcggctgataggcagcggctcgtcagtccctactccgtacaggaaacagagctggttcctgggagggtagtatgccagatcaaatgtttttaagtctcctcccctgcactggttctcaaatccacaggcatagggaagcgtgccgaagaataactgcccgttcaactttgcgtgctggatgatagccctctgtcccggattgttcaaaatcatgttacagataatcggagcatcatcaacataaagctccgcaacaagcctgacatcatcaatcataatttcaacttttttgtttgccatgataaccttcttcctttcctttttgaaattaatattttctgctcgagttccgtatcgcaaaaactatttgtatcttcataataggatggttttatctattaagcaactgaataatacttatggtatacattcaattattgaatatcagtaagccaagaaagaatcccgctaagtgaacaagccctctttagagttgcgagcctccgcggagcggtttttatttaacaggagaaattcctgtaaaataaaaaagcctgaaaagataaggtttttatttccttatcttttcaggcagcggcctgatacagagcggcaccgccggaatgtaccgaagaacctgaaccggcctcagtcggcccatatccggatgtccgcctctgcactcctaaatctcaacccagaccatctccattgccttcatatccaaactgcatttcagcgagccatggataaagaggtcggtcatctgatcctcttttgaattgttaattacggcaacgcggccggctttttcaaatgcggcaacttccgtttccacattcgtcacataatatttcttcatctcttcttccctgtgggcggcatagtagatagcccttaggaggattctgcagttctggggcgaatatggaagacctgtgaagtaaacgctgcgtcctttcccatagctgtttacaatcagcctgctgtactctccatccatatcaaggatctcataattggcgccctgggcataaatccggttcttgccctccccgaaatctatctcaccttttatatcttccaatataaaatggtctctgtattttggggaaagttcattgtatttatctgtgctcatggagaatcccatctctctgtcggccccaagaacatcacttaactggaagtaccggccctcatactggcaggcagtcggctcacccacgccgataaatccgcctccctggtcaacgaagcggcgtatagccgtaactactttctcatccgtccagttctccgctccgctccaggccgtatacgcatctccggcattgataatcactttaatatcagggtcaattccgttacggacgtcgtcaaagcttatgaactgtacttccaccggcattccgctcaggcattcaatcacccccacataggaataaatttccctgtgccagatcgcgtggtgaacctggttgcacatccatctgcgcagttctccccagcagtttaagattgccaccttaaacggcgccatataggagctggttccctccattgcctcatgaatctggcggaattcaccgaccaccttttctatctgttcgataaagccgggccactcggaagccagcttcagataaccaccgtatccaatccggtccagcggagatcgcagaatcgctctcctagccttcatccagttatcctgtgcctccccgatcggatcccctccctccgtaaatacatccgggaagaaatatggaagaagacggccctccgtgtaattaacacccttgatatcggatatcatcctcattgtaactccgtctccgacagaacctaccacggcatccagaccgatgttgtcaaagtatttgccgaacggttccgttccgatccagtgatctcccaggaacatcatggcttctttgccgtaggcatggacaatgtccaccaggtctttggccagcctgctgacctctatttgctgaaattcgataaagtccctgaattccttcgaaggaacgcggaaggttgaattaaaatatccctgatccacgatatattcaggacggaacctgtagcctgcccaatgctcaaactgctccagtatgtagggactaacactggcgctgtagccgaaccattccacatacttctcacgcttctggtcatcaaaggtcagggtaaactgatggaagaaggtggtaaaccgcactacgtccacatccggattttcctcgcaccagcttctcagcttctcttttacatatgcctgtgtcttcggctggcgtacatcaaaggtcatctgatgttcggccccctgccagtcattcgtcaggtaattatacatatgaaccggatcccagatcaaaaaagccaggaagctgaccgtatactggtgatatgggatactcttgataatcacttctccggttgcttcatcgtaaaaccagttttctacagggaccaccttgccggttgtcctgtctatgacctcccaccagcgctttggctcatctatcgtgttgaccttcagctgctgtgtgtgaaatcccttcatcagttcaatggaaagcgtccagctggtagccgtgatgcgatccgttatcagatattcctgctgtacttcctccgggttgttcttcgcccattcgttatctttgcgggttgtataataggttgcgtaaatttttgcaccagtttttaaaagttcggaaggcatctgtgtgccgtcacaatctctcagtgcatcggcatcaagcctttcttttaacttcagtgtctcttccaccatatctacgtctgtaggcagtgtaagtcttcctctaactttcatcattcagtatcctcctgaaatcctttgtagttcacctcttaattctaactgcgcagcccggacttttttgccgataaaatgatttttatggcggttacggctgattagtaacattatattcattctgacctgctgacgctagcagattcttgtcagcttttttataattattgctcctgcatcgacatttttcaacctgatatttacaaatttctttattttttctataattttcttaacattcctatttggaggtacttttatgagcagcagccgatacatttttaataatgaagactttgagaaactgaccgccagccttctgtacatttccacctcaaaatatgaaaatgactggcagagcattccccatatccatcacttctctgagcttatctacattacggagggcaggggattcttcgcgctggaaggcaaaaaatatcaggtgagcgaaggagatttgattattattccgcctgacatggagcatacggaactttcttttgactgctatcccctggagtatattgccgtgggtgtgagcggaatcgccttccgcgataacaaaaacctggaacggttctttatctgccattatggaacagatacggagcttctgtccatcctgcttctcttactggaggaggcggaagaacagaaggccggttacggcgcagcctgccaggctcttctggatgtcctgctgatccgccttgtccggaagcaggagcttcttccggctcacttcaccccgtccaggatgacaaaggagtgcagtcagattaagcggtacctggattctaattttgcagacagcattactctggatcagctcgcctcgctgacacatatgagcaaatactatctggtccatgcatttacccggtattccggcctgtcccctattaactacctgaatgcgcggcgtatcgaaatcagcaaggaactgctgcttaccaccgatcattccatcgcccagatagcctctcttaccggattttcctcccagtcctacttcgcccaggtattcaaacgggagtccggaaaaacaccggcccaatacagaaaagatttatccggaaagagccgctgactgcagcagttcagacagatctgcgcattggctgcgctgaccgtgtgaaaaggtaatagcagcgatctgatttccattttacaaatattatgagtaaaaatcaagttctatacatcatttctcgagtaatgaaatacaatattttcaatgtatgataaattggttctacaactgttttttgtaagctagtagaatcagaggtgatggcatgggaattctgggagagcggctccgccttttacgtgaaaagaatggaaaaacccaggaagatatatctaaagtaattggtacaacacagcaaatatactcgcggtacgagaccaacaaaaccgaacttcctgtgcggcatctgctgaatttgtcttcctactacaatgtcagcacggattatctgctgggccggatcgattatcccaaaatcgcccctgaattttcaaattccctgattcagaatgtaacaattggggattttgtatgcagaatagattcattcaacagcaaatcgaaacggctgctggtggattacgttaattatcttacttacatggaaaacacagaaaaattgaaaaaagatgacaagactaaaaatccaatccaataacgataacctgcacgccctgcgcacagttcaccgccttcaataaaggcaggtgttcccatcacggaacacctgccttaaattgtaggcacactatatttttacatctaaagcacggggggcaaaaagcccgagtttaaggtcacgccgcggggctgtgaacagtaacattaatcatcctcttcctggctgtctgttacggtaaatacctgacgttttcttgccatctcatcgcttgccagatattcatcgtatgtggtaatcttatcaatcagtttaccgttcacaatctccatgattcggtttgccgtcgtctccacaatctgatggtcacgtgacgagaagataactacacccgggaacttagtcataccgttattcagggctgtgattgactccatatccagatggtcggtcggctcatcgaatatcaggacgttggcgccggaaatcatcatctttgaaagcatgcagcgcactttctctcctccggaaagaactttcactttcttcactccatcctctccggcaaacagcatccttcccaggaacccgcggacataagttacatccttgacaggggaatactgtgtaagccagtccacaatcgtatcgtcgttgtcaaactcggcgctgttatccttcgggaaatacgcctgggacgtggtaagcccccatttgtagcttccttcatccggctccatctctccggccagaatcttgaacagaaccgtcttcgccagctcgttcggtcctaccagggcgaccttgtcttccctgttcagaataaatgaaattccgtctaatacttttacgccgtcgattgttttggtgaggttctccacacacagcacttcattgccaatctcacggtcagggcggaaatcgatgtacggatatttacggctggagggacggatctcgtccagctcaattttctcgagcgccctctttcttgaagtcgcctgtttggatttggaagcattcgctgagaaacgctggataaattcctgcagttccttaattttatcttccttcttcttattggcttccttcatctgcttaatcatcaactggcttgattcataccagaagtcatagtttcctgcatagagctgaatcttgccatagtcgatatcggcaatctgagtgcagaccttgttgaggaaatacctgtcatgggatactacgataacggtattctcaaaattaatcaggaattcctccagccaggcaatggcatccagatccaggtggttcgtcggctcgtcgagcagaagaatatccgggttcccgaataatgcctgtgcaagaagtactttcaccttcagaggaccgatcatttcactcatcagcttataatgatgctccgtatcaataccaagtccatttaacaggttggcggcatcggactccgcctcccagccgttcatcgtggcaaactcgccttccagatcggccgctttgattccgtcttcatccgtgaagtcttccttcatgtaaatggcttctttttctttcatgatctcatacagtctggcattacccatgataacggtatcgagaaccgtgtatgcatcatatttaaaatgatcctgctgcaggaaagacagcctctgtcccggagtaataatgacatctccgctggtcggctcaagctgccccgacaggattcttaaaaatgtggacttgccggctccgtttgctccgatcattccataacagtttccttctacaaatttaatgctgacatcttcaaacaatgccttttttcctacgcgcaacgttacattacttgtgctaatcatatctgtttcctttcataatgcactgctttcaatttatgcttactgattgtctgtcattttatgttctgagttgcaacaggcgggccttgccgctcattcccgactgcgtctcttctattttacaggaaaattattattttgcaagtacccttttcgtaaaatccctgaaaaacaaaggggttgcgcagctgaatggagatttaattaagcaggtgaggacgccgccgcaggccagcggacggggtggtggggtggggttatgagtctttcgtctcgggggaagattgttgtggtatggggctgtgggcgaagataaagtctgcggagcacactcccgctctgtgaaatgcatcgcgctgctaagctcgacaggacctcgctaatcagcgatggatttcaacggcatccgcagactttatcttcccctccgccccaaggccaggttttcgccgggacgaaagactccgccgggggtatcggccctgtccgccggcctgcggccgctgattgtctcacgcgttaagtgcgggggcggaccttgtcgcggccactcagtgctaccgtgtacgggaaatacgatatgccttcattgcgcctttataaaaggcgctagatttggtatctgcctgcggaaacacgtagtggccgcgacagggccctccccatttaaggttggagacaatcagcgcccggaacggaccatgtccggtgtcgaaaacctccgcctgaatgttccgtccccggtgaaaaactgacccggggaagtaggcggaatcaattgcggaggggacatgggagtccgccggtgcttagcgaggtcttttcgagcttagcactccgatgcgcactccaaagagtgcaaacggtccccgcagcaattcattccggccggattccccctccacaaccaacttcccacggggacggaagactcagccagcccccctcaccacaccggacatggtccgttccggacgcgtcctcccaacctcagttaaatctccatctacagtcccaccagacacattgcagccgtcctcttcctgtgttatactcaaaatagcgtaaaaacaaaaaccggactggaggtatattatgtctttcgacgattattctaaagcttataaagcgggtaagaaggagtatcagcggcacctggccgagggaagctatccttatctgcaggctctggacgaaagtatttcccatattgatatcgtatcggaagtaagcttaggtttacagcagattccgtcggagctgatagcgggaacaagaagtatcggccgcaggacagcctttgcgcctaattatatgccccttctggatccgcattcggaatttgccgccaaatggatcaatctctgcggctcccatctgaaagaaggtatcagggaaccagtgaccgcctgcgaatttatgggacacttttatatcgtggaaggaaacaagcgggtcagtgtcctgaaatattttgacgctccctttattcccgctgtcgtaacgcgtttcataccgcgcaggacaaaggaaaccgacaatattatttattatgaatatatggattttcaccgtcttacgggaatcaactatatcctggccggcagggaaggcgtctttccccgcctgtccgctgctgttgccggcggaagcaaaattccctgggacgaagagacccggatggatttttctgctgcctatgtcaaattccacagcgcctatctggccagaggaggcggacgcctgccaatcaagaccggtgacgcccttctgtcctacctcgatatttacggttatccagccttaagagatgacccgccctctaaaatcagagaaaatatcgcaaagatctgggacgaatttactctgttgaaagagaagcagtccgtcgaactggtcatggatcccgtaggcaccgccccaaagaaaaagtttatcgatatcctgcttccgccgtctccgaaacaggtgaagatcgcatttatccattccaaaaacgcagcttcctccagctggacctacgcccatgagctgggcaggcgccatgtggaagaagtatttaaaaaccaggtggaaaccatctgtatagacaatgtcacggccggtgataaagcccaggaggcaattaaacgggcggttgacgaagggtgcggcattatcttcaccacaacgcccgaatttattccctccagcctgaaaaccgcagtggagtatcccgatgtcagaatcctcaactgctccctgaacacttcccaccgctacataaggacttactacggacgaatgtatgagtccaaatttctctgcggcatgatagcagggactctggcagacaacaaccgtatcggctacatcgccgattacccgatttacggcatgactgccaatatcaatgcctttgcgcttggtgcacgcatggtaaatccaagagccgagatttttctgaaatggtccaccgtcaaagaggatgacattgttgaatatttcaggaaacaccacatctcatatgtatccagccaggatatgataatcccgcggttcgcttcacgccagttcggtttataccggtttgaaaatgcggccgacggaaccatgccgtttaatgcggccactccgctttggaactggggaaaattttacgagaagatcataacgagcattatcagcggttcctggcatgataatgaatcatccgacagcagagccctaaattactggtggggcctgtcggcaggtgtcgttgatatcatctatacccagaatctggcagccggaacgaaaaaactggtggaattcatgcgccgtgccgtggaatccggctccttccatccgttttccggaacgctgtattcccaggacgggatgatacaaaaagatgacgatcatacgctggctcccgaagagattatcacgatgaactggctggccgataatgtcatcggctccatacctgattttgaaatgctggcagacgaagcaaggccggtagtccgccttcagggtctcagaaagccgaaagacggaggaacgatttgatgaaaatactgacattggccgaccaggaatcacgatctctgtgggattattttgaaaaggccaaacttgagggggtggatctgattatctcctgcggcgatctggctcctcaatacctctcattcctggcgacctttacccatgccccggttctctatgtccatggaaaccacgatgactgctatgaacagacgcccccggaaggctgcatctgtatagaagatacaatttataactataaaggaatcaggattctcggattgggaggctccctgcgctaccgtgacggcctcaaccagtatacccagaacgccatgaatcggcgagtattccggctgtggccaaagctggctctgaacaggggcttcgacattctcgtaacccatgctccggcctatcggttcaatgacggggaagatattccgcacaccggtttccaggcctttaaccggctgctggaaaaatataaaccggcctactttatccatggccatgtccatgctaattacggcgggaaatttaagcgcagttctgtttacggggataccgttgtgatcaatgcttatgagaaatatacgattgaaatggagaaggccgaaccgtaaagaaccagttcaggcaccatgatccgttacttatctcgttactattcacggccactattccgcgaggtgtggctatcttcccactaccagggtggattcggaactttcatctgttagtgacgtgcgccgccaggcgcactacaaaaggagagaagtcaatcaatgctgacttctctccttttgccacgccgcccatcttattcaattgtgattatcaaactctaacctgccgccgttcggcagtttctttgcatctttgccgctttcaaatcactgaatcagctccggcacgtagattgtctcccccggcttatgggaataaaaaatcgtcactttatcaccctccagcggcccgcttgtgaggttaaccggcttgggttcctgttcaaaagaaacctctgtccctgccccggtcttgattgtgataacactcataccgactccaaggacttctcccgataccacgcccgcccggcagtctttatctccgtccctggggtctcttacaagctctgcctttacaccgcttgaagaggacaaatctatcttcccccggtagaagaccgtgacctcgtgttccagaagcagtccgtccaccaggcttacggccgcatcctcttttgcaaacacgacgccgtccggatattctttattcgcaaccaccatcgtattcattccggcatccttgacagtgccgcagaaaataccgatatcatcctccgattgaagctccggcattatcctcgggtcttccgtactttcgttttccgccccggaaggtaccgtctcttcccccgtgggctgtcctgtcccggcaggatccgtttttttaccgcagcctgccgtcatcagggcaacggccgctgtcagaagcagcagcaatgcaaatctgttcatgatttttctgcacatattatcacctcccgtgttactattcgccgcctcgccaaatagcggctgaacatagtaaccttcctgtctttattgattctggttcagacttaacggccttcctggaaacggccgaatgtatcgaccagccatgccaggtagcccgtctgttcctctccaaactgccccggcttcatcctccatctccagtttttccccaccgtactcggtgtgttcatcctggcccagttatccagcttcagcacatcctgcatctgaaatactgccacactggccaccgaaccgtaagccgcccggaatactttatccacaacctcgctctgatgtgcggctcccagatagtcggcaatatactgcagctcccaccactgcctcttctctgttttaaagtaaccggcaagcgtttcattgtcatgggtgcctccatatacgacggaattcggttcatagcaatggggaagatgctcattgaagcggtccccgctgaatgcaaattcaattatcttcattcccggatatccggtttcagccagcagatccttgacatcctggctgaaaattccaagatcctcggctatgatttttgtcgccccaaccgcttcgcttatggcatccgtcagtttctttcccggccctttttcccactgccctgatttggcattttccgccccatacgggatggaataatactgaaccactccgataaagtgatcgatgcggattacatcgtagagagcggatgacgccttcatcctctctttccaccaggcaaatcccgttttctccattttatcccagttataaagagggttaccccataactgtccctcatcggaaaacgcgtccggtggcactccggccaccttcagcggtataaggccttcctcatccagctggaaaagttccgggtggctccagacgtccgcgctgtcgagcgcaacgtaaatggggatatccccgacgattttaacatcgttatctgacgcatactttttgagtttttcccattgttcaaaaaatttatactgaaggaatttccagtaatctatctcctctttcagttctgttttatatttctccatggcttcaggctttctgaatctggcctcctcctcccacgccagccattcattgtcaccgaaatgttttttcaaagccatataaaggctgtaatccggcagccaaaactgatttttctcacaaaactgccggtatgcttccgtcgttttatgtaaacttcttgtgtacgcctttttcagcagtggaaagcggtaataaaaaatcgcatcatattctacttcttcctgtttgtccagccagaaacaggcatcgatttcctcctgtgtcagcaattcttcctctttcagcatatcaagatcgataaaataaggattaccggcaaaagctgaaaaagactggtacgggctgtcgccatagctggtcggccccatcggcagaacctgccagtaattctgtctggcctgtcttaacaggtctataaattcatatgcgctgctcccgaatgtacctatcccataaggagacggcaggctgaaaatcggcatcagtatccccgcgccgcgctttaacattgtcttcattggttaattctccttattcttattacaggaatgccttcagctccgagagccttcgtatttccctcgtaactgaaatccttttcctgttttccttcccctggggattaaaccagcaggtatcgataccggcattcacgcctccctgaatatcggatgtaagagaatctccaataaccatcatctcctccggccccgcctccttgatatgggcaaagcaatattcaaaaaattccttctgcggtttctggctgcctgcctcctccgatatgaaaatatcacggaaatacttatcaaggcccgatgccttcagccgttttctctgagtagctcccacgccgttggtcactacgtaaaggggatagcgctctttcaggtaatcgagtatctctaccgctccctccatcagatatgccccttcgcccagccagacacggtacgcgtcttcggcctcctcaccgctcatggacaggccatgcccgccaaaaaagcgttcaaaccggacagtaagaacgcggtcgcgctccatctgtccgatttcaaatgcttcccagcattcctgattgattttgtgatactcctgaatgaaccgctcctccgggacaaagccgtatttttgcaatactttcgtgaatgcggcggcttccgcccggtcaaaatcaagaagtgtcccgtccacatccatcaaaagcgctttatattgtctgttcaagcctcaaataccacctttccgccgcagattgtaaacctgaccctgccgtatagcgtttcaccggtaaacggagaattggaggacttggaaacgaagtctcccacagtgaagctctccctgtcatcaaaaatcacaagatccgcatcactgccttcttttatacggcccgaatccaggcggtaaagtctggccgggttcaggcacattttttcaaaaagctgcacgtaagtgaggtggccctcctttaccaggttggtgaccgccagcggcagggctgtttccaggccgataattccgctgggagccgccgtcagcggcttctccttttcttccctgctgtggggagcatggtctgtggctattatatcaattgccccgctctttagcccctctatcagggcctccctgtcttttgccgtccgcagcggcggattcatctttgccagtgtcccgtgctttaagacagccgtttcatcaagagtaaagtggtgcggcgttacctctgcccaaacgtcggctcccaattgttttgccagggcaaccatttttacggaattccgggaactgatatgctggatattcaccgctgcgccggtatgaagggcaatcatacaatccctggctaccagtgaatcctcggcaagagccggggaaccgccgattcccagctgatccgataccacgcctttgttgattccgttgtttatgataaaggcaggatcttcctcatgaaagctgagaggcagattaagctccctggccttctccatcgcctgctttacaagcttttcatccattaaaggaataccgtcgtccgtgaaaccggccgctccgcaggctttaagcgcatccatatccgtcagctcccgtcctttcagccccttagacacggcggcggcagcgaggacgtggatccctgtctttttacctttttctatgatatagccgattgtgtccggattatctgcggccggatttgtattagccatgcagaccaccgtcgtatatccgcccgcttttgccgcagcggcgccggtttcaatatcctccttatgagtcaggcccggatcacgaaagtgtacatgcacatctaccagcccgggagcgataatcattcccgatgcatccagcacttcatccgctccgtttaccctctcaggaaccgtattatccgccccgccgtctacccgttttactatctttttaatctttccgttttcgatcagcaaatccgccaggccgtcaaagccgctttcaggatcgatcacccgtccgttcttaatgagcatgttccgtattctccttcatcttatttttccggtactatctccagccagtatccatccggatccgagataaaataaattcccatagatggattctcgtagcagacgcagtccatctccctgtgtttctttaaagacgcatccatatcatccgtctcaaatgccagatggaactcgttgtccccaagattatagctctccttctcccagtccctgagccaagtcagctccagctggtagcctgtggccccgtcgcccagataaaccaggataaaactgccgtctgccgcctctttcctgcgcacttcgtgcaggttcagcgcctcctcgtaaaatttcagggatttttctaaatctactacgttaaagttattatgtgcaaatgtaaatttcatatagcaagttcctctccttctctgtgaatttccacaagacgctccctccatccttcactggacggatgctgtctcatcttctcaattatactgtaatctttccagaaatgcatcggtattaccgcctttgcgtcgactttttccataaactccttcatccccagataaaaccactgctccagcctcggatccaatgggacaaatgcagcatccacggtgcgtccctccatcttttccatctcatgggcgtaatttgccgccatattatggttccaggccttgtcctcaccttcccaccaccagttgttcagatcgccggcatggtaaatggtactgccttcgcaggtaatccagaaagccaccccttcatcggtggatttgaacgtttcaatctccagcccggctttccttccttcggtatagagggtcagcttttccccagcctttacaaaggttactctgccaatcagattgtccggcaccttctttttgctgatgtctttagagagaacgtaattcacatcctccctgtcctttgccaaatcaaaaattaccggtgcaaaatgatctccgtgaaaatggctggcaaaaaccaccagcggcctgtcttttcttatctcaggcagctgtcctgcgtaataatcgaacagcattgatacatgctctagctccaccagaaaggaactgtgatgaatatatgttatcttcataatcctgcggcctccctaaatgcctccgccgattcggctttcgccgcaagccttagccattttgtcagtgtcttcatatcggtctgggacaggatactggccgaaagctgttccggaacaggtccggtttcctcgagcaattcaaggactgcctctgcctttcccgcctctcttcctctttctattcctttttcaatccccttttcgatccccttttcgatccctctgtgttctctctcttcaagttcatccgcaaataattcccttaaagcattgcacatcatttttccctcctcactgtttttccagttggcccggataattaaatccatagccgcctcatataacggattttgcttttctttccggtattccgccattaaaggctctatatccccgtgaagttccagatcttcccgcaagcggctcagccagatattttcccctttatccagcctgcctataaccagaatttgcatggggaacagcaggcctgtaacataataaattccgggaaacatctctgtagtctcggctttgtgaacctttttcaggtaattcagcatttttccgggataatgatttccgaccagagtaatagtcatgtcttcaggagatatctcaagtatctgcctggtattggactggtatacgcaggcgtagcctgttaccttgtaaaaatcgttaatgctgatataatccgtggggcttttatactccacgatattgtattgcctgaaaaaagcgcctatcttctttcttattttcctgccagatactgctttgataattagtgtgtccatctgcagcggcttttcagtcagattatattccttcaaaaactgaagatactgtgcctcctcaccaaattcaatctgcaggattgcctgaaaggcagggtgccactgtaatattcgtttctccattcaccgtctccttcttattataatcaaaaaacgttttgtcttcaataggcatccatagactccacctgcccttcctgtatttggtttgttataatctggtttggattttccggccgaacggccatattacggcgcttcaggaagcgcgccggactgctatggacagcagtccgaatagattattcttaaatattaaatttcaataaagtttttagttaaacaggtgggggccgccgggacgaaagagtcagccagccccctcaccacaccggacccggtccggcccggacgcgtcctccattctcaatcccccatctgaactattgcttatttttctttttttgccagcgctttatccataaacttttcattcttgacgataaacctctcatgctcgccttcaccgatttttccgctctcgtcaaaagcctcaacatggaatacaagtcttcttccatctacttcttttaattcgctttcgcaccagacaatcatgcctgccggtgttgccgccagatgctttatattcagcattgttccgacggttccctcaccgtcattcatataaggagcgacgctcatccacgccgttttttccattaatgccaccatggccggtgttgcaaatacttccagaagaccgctgccaagcgcgcttgcagaattgtcctctgtcaccataacttcctgtcttccctgaattcctgcttttaacatcttctctacctcttttctcatttttcacttaagtctcatttttcaaaaacgctctggagcatgtatccgaaactatagcagcagtgctgatactatggtttctggctggattactaaagtttacgtccgcatttcggacagtaggcaaattcttccgccgcctcatatccgcattccggacaccttttgcccgaatgccccgtcagagaaccgtcctgagcccatggattgccgcttccgtcacggcacaaagtcaaatctgtctcacggatttccgcatccattcctctgagcagtttccggccaatctccggatccagctcatagacagcgccgcagcatgacatcttcacatagaaacgcctgttccacttgaacagcggaataaagaaaaaactgaaatacatataggtcataaagacctgatatcttccgtacgctccgcatctgctgcagataaccgttttcatatattcaatctgtttcatgccggaactgattccgccgataaatatcatatctgccacctgctgtaacagttcagacagcgcgaactgttaccacctgttctttattttttatgtttatgggatattaacaagtatactaaagtgattttagttgtgcaagatatattttaattaagcaggtgaggacgccgccgcaggctttaagtgtggaggcggaccttgtcacggccactcagcacttccgtgaacgggaaatacgatatgccttccatgcacctttctaaagaattgcggaagatatgatatcagcctgccggtaacacgcagcggccgcggcaaggccctccccatttaaggttggagacaatcagtgcccggaacggtccatgtccggtgtgcgaaaaacttcgcctgagtcttccgttcccggcgataacctgaaccggggaagtaggcggaatcaattgcggaggggacatgggagtccgccggtgcttagcgaggtccctcacgagctgtcgagtagatatgccccttgcgtggcatacccctcacagaatccggacgtgcggatttcccgcatccggctctttataaggttcattgttcgtcagttcaagcgtatatactcacatagattttaggtttcgccaatgggtgctgcttcatcatttccctgaacccttcccatgtataacttttcttctgactcctccggttcagccacttgtacagcgtcttttctacctcccggtagaacaggccgatactccgactgttatcggtcagtccatagtaatggtagtatccaactaatatctcattcagcttcttcacctgcacggaaatttccttatgacgctcctttttgatttgcgcatggatttccctgcttttcttttgcagcttctttctactggttttcctcttcacccggaactttccgttcctgctttctgaaacgtagtgtgtaaagcccagaaagtcaaaggttcccgtcttctttccctcacgctctgctctttcttttgcaaagcggccaaattctatcagacggctcttttcttcttccaggctcagcccgaagtgctccattctatgtttcaagcggctatagaattcttctgcctcctctttatattggaaacaggctacaaaatcatcggcatatacgattagaccacagtatccccgcatcttcggcttaactttttcttcaaaccaccataacagtacataatgcatatagatatttgccaggatgggcgaacacacacttccctggccggaaccctccggactttcctgatacccataatcctccatgattcccgctttcagcgtccttcttatcagacgcgtgatgttcgggtctttgattcttgattccacaaatctttctatccatttatggtccagatgattaaagaaaccctggatatccgcatccagcacatagttcgttttttctctttccagcatctgatttagcttcctcagcgcctgatggcagcttcggcctggtcggaatcccatcatgttgtcataaaactgcggttcaaacacagcctccagtatttctctcagtccctcctgtaccagcttatcctcgtagcagtagatgctgattggcctggtctttccgttttctttaggtatctctacctttctggccggctttggcttatatgcctttcttttcaggctttccaccagtctggccagattttcttccagattcttttcgtagtcttctttcgttattccgtcgattcctgccgctttctttccatccatttgttcgtggcaccttttcagcatttccttattaatcagatgcccgacggatgtgaataccaactccggttgttcgcttgataactgcgatattctctccaatttcgtttccatcataggtctacctctgtgtatagttgatgtttcctctttgatattgccttatatggcagggctttgaggattgatgccctctctcggcttccctccggcggcattacccgctttctccggtactatccggccatccgactgcctgccccccttttgccttcctcgcgtccggcatacccatgcgaacacacttcccacgggaggggacaggctctccccagttgacgtgatatcattgtgtaacgtggctggctctcagacaccgcggcagtgtgtgaaatctcaccattgcgataaacccacctgttgccttccgctatgctaaaagcgtcggcctgccggacctgcatcgatttcggtactctatcactttcagccctgttacctgactgtctacgcttagaaggcagcattactgctaccgactcaagactcgctaccggtggtgtggttagcacctttccggacaggatttccacctgttaaatatcacgccctttctgggcgcactagcattccgatgcgcgctccaaagagttcaaacggtccccgcagcaattcattccggccggattcccccctcacgacagcctccaatcggggacggaagactcagccagccccctcaccacaccggacatggtccgttccggacgcgtcctcctaacctcagttaaatctccatctttcatccccctctcaagtatggtaaaataataaagtgaaattttacatgaaaaggacttacttatatgattacaatagagataaaccactttgatctgcggcaaatcgccgggtccggccagtgtttccgcatgaactgcctggaaccgggactgtattcggccgtgagcaggggccggtatttggaaatctcacaggaagggcagcagtttcattttcattgccctgatgaggattatccgttctggcaccattactttgatttgaataccgattacggtgctttcctgtcttctgtcaaaaagcgcgaccactatcttcagaacgctgccaatgcaggcagcggtatccgtattctgaaccaggatgcctgggaaatgattattactttcattatctcccagcagaggactataccaaaaatacgggaggcagtggagaacttaagccgtctgtacggcgaagaaaagcattgtacttttcccggcgggaaaaccgttgtatatttttcctttcctactccggcccaattaaaaaaggcctccttagaagaccttcagtcattaaagctgggctaccgggcccgctatatccaccgtatctgcctcgatgctgataacggtacactggatttgaaccggctttccgccatgggctaccgggatgccatggaatatctatcaggtttttacggcattggaacaaaggtagccaactgtatctgcctattcggacttcatcacatcgaggccttccctgtcgatacctggatacagcagatactgacaaaccattactaccgtaaaaaatacgatgcgctgcctaaaagccgcctgtatgagacaatggtgcaggagaatttcgggaaatacaaaggctatgccggagtaatgcagcaatacatattctattatgaaaggactgttttacacggcagaagctcctgagccgggaacttatcacaggttcagcagaaccagggccgcaagaatcaggccgcacccatacacctggcgtctggtcatcttatcctttaaaagcagtacgctcacaaagctgacaatcaggatggttcccacgctgaaacagggataaacaaggtaagcagggagtctggtgacggccgccagaagcagggaagtggaaaaataattgggaatccccacaaaaattccgctgataaaatctgccgcactcatttttctgtttacactgaaccgttccctcatcatcggaatcaggctgagaaccagtgccgtcaggaaggtgtaaaataaaaacagggcgtcaaaccgtcgttctccgatacgttcaaacacctttgccatcccgtcgcccattccgctgaataagaacaacacaaggaggagcatttttgaagatgcccctccctttcctttttccaggttgatcactaaaatagcggctgccaccagcagcattccggctgtctggaggagcgtgggtctctcgttcaggaacagaacgctggctgccacaggcagcataatccccagcttggcaaaagccgaagataacactgctccattctttttaatactgtactgcaaaagcaaaagcattcccaaaaagaacactccgttaattataccggccagtaccgcagtcatcatggcggactctgcaccagcctccgctcccgcccggaacagattcgtcagggacggtaaaatccgcttttccggcagcagtatatacgctataaacgtacatgtcacataatttcccgtcaaaattgcatatttattgctgctgtatccctcgctcaggcgcagcgcaacggccatcgaagcgctgcagagagctgccagtatcaggtaaatcatttataataaatctcctgtctctctgaatcttctgtaatgacggctctgttttgcgtcctcaagggtcctcatcatttcggggatatcttcattaagcgttcccgccagaacgacataatttgacgcatggttcgtacggaataccgttcccggtgaatccacattttccaggaaaattttcatctcatccataatttcatcggccgtaatccgctcgaaacggccctccaccacgtcttcgtacatcggtgttccctcatacaggcgcagggtcagaaaagaggcatattccgggttcatctccgtgatcagctttgcacaggaaagagcatgctctttaacctttttccttccgccaagcccggatatcagcgttaccgaggttgcaatgccgcaccgttttaatttctgtccggctgcgattacttcccctgcggtgactcccttgtggatgtattcaaggatttcatcatctcctgtctccgctcccacatagacaatccccaggcctgcctcttttaacaggcgcagctcttcttccgattttctgagtatatcctgggcagtcccgtaggcggccactctcgtcaccctcgggaacagttctttaaccgccgccagaatcgtcagcagatcctctgttttcataatcagggcatcaccgtccgccaggaataccttctggacgtaggctgcataggcgtcgtgggcctcctgtaaatcagccatgatttcttccatcttacgcaccctgaattgtttatccttatacatattgcagaatgtgcaggtattatgcgcacaccctatcgtcacctgaacgatcaggctcctggcctcgctggggggtctgtatacaacgccttcatatttcattctatcttcactccttattcatattcaacccggattctgccggcagccatgcaggaaaatcctttcctgctttcaggctcagcgaattgtggtctttcttcgtatccttcagtattgcgcttaagcggtcaaaccatttgcttgttcccagataacgttcccagtaaaaataagtccggctgctctttatcctggcagcattgattggttttcccgagcagtacgcgctgtttaaatcgccgtaaagctgcgccatctcccgctttctttcatccggtattgattccagccctttaaatgtctggttactgataatatccacgaggaactggctgctgtactctttaaaattcagcagattgggatcttcttcctgataacgctctgcccatcccgatatatccacctcttttgtatgataacggaaactgccgtcatttgtccagttaattattccatactggcagggaggaatcgcaagcgatgacgacactatttcatagattccgtactccccttcctccaatggtcccctgacattcttcttgatcctctgaagatgaagatgcccgcttatgtatacaggtaaatggtattcttccagcaaatcgatcacttccctgttgttttccagcgtacattcttccggataaagcgtactttccttcaagagattgtgatgcgccacaggaatcaccatggccccggcctctttggcttcctcaagctgtctctccatccaggccagcgtctctttttttattctgcctccggtctcgtgtacaggctcataaatgcaggagtccagcatcataatccaataatgttcatccagcctgtacaggtagctcagggagtcttcatccctggaagatgcctgatcatagccaaattcatggtaaatttcataaaattcacttggggtcgtacccttcgcctcttccttcttattatcgaagtaggaggcggcccagggatggttgatatcatggtttcccggaattacgagaacggggattccggcatcctgtacctgtttcagcttctttgccagttcctggtggtttaccttctcaccattctgggagatatctccgctcaggatcaggaccgacggttttttcatcatgacctcttccagaaaagcgtcggcaatcacatcgagataaggcaccaccgtcccgtcgttccattccgtataagtatccagtgactctctgaaatccgtcattttaggggactggtaatgtaaatccgaagccacaatcattgtaggagggacatatggcttctcttcctctgcaggctcactctcttccgttaccgaacgggacggccgttttgctttctgtatttttgcgccatccaaagcagcgtctcctccgctgtcctcatcaggtttcgaaacgtcttgggccgcgctgctctccttcggattttctttttctttcgtctgctcctcactgctttcatatgtagattctcccgcgccctttttactgaaatcgggaataaaacgtacaaccagtgcaatcaccgcaaaaagcagtaaaatctctgccgcataaacaagcagagacattttacggttactttcagcagccggcatgcgcggcgaaacgtgacgcgccgtgccgccggatgttttggggcgttttttacgcgaagctcccggggtgcgcggcgccacactgtgatttttattattgccgggctgcgcatgtgttacgatccgccagactgcggctttgagccgggctaggaaccgcagcatgtttctccatcttctcattctatatcaagtcctcttatcagctgcttaaacgtcgtttactccggagagtttaaagctctgccgtcctttgcaaagcattaaacaattgtttttccctgtcctcaaacaggaggtttttattgtattcataataacgctcacatctgttttctctcaaaaagttcacactgtaataatttgtattcagctccgtcacaaaaatgaccatctcctggcccgccgaaaaggccgcttccataaaatcaaatccgtgctccagcatcctcagggcttcctcagacaagctttcatattcacttacctctgccgcgaaaagctccctggccttcaaaaaaccatcttgcagggaggacaaaggttctttctccattgccagagcgtaatcctccagtttttccgacacgtcccgcatcagatattcttcttttttccctgtcaatccggctttccgcttcttttccagacggctgttcatcctggccgcaagctcttttaacaggccggcagggtctgcgccgtccggattctctgtccggggcgcctctgttgtcatctgcctgaatttctccagctcttccttcataagtcccagatactgctctttcatccaaatctcccggaactttccgttcagatgggctaaaatcaggctgagaacgctgaatcgttcatcaaaggatgcggccgccacgcggcgaatcatctccccgtccggctttccggacagaatccgctctatctgataatctgtcttatatttcccgtaaagctccagatagttggcaaaatcctttgcgatacccggatgttcaatatactgatatatcacgtccctgtcaaccgtttttcccagtttttcatatatttccagaaaacgggcgagatcctcccaccctcggggcgtggcaaaccgcttcccatccacagtcgtttcaattttataaaaatgctccggcctcgcttccaggtatgccgtcacggcaggatggatatcggtcatgaccgcatattccttccagactgcataatcggcttccacatcaatttttttaattctgtccagcgttgcaatatcaaattccctgacggatttgttatattccggcggatttccggccgtcacaataatccagccgccaggaatccggtggctgccaaaagtcttgttctgtaaaaactgcagcatcatcggtgccagcgtctccgagacacagttgatttcatcaataaaaagaatcccttcccgaagtcccgtctcctccatcttgtcatagatggctgcaacgatctcgctcatggtatattccgtcacggaacacggccgtcctccgtattctttctccacaatataaggaagaccgatggcgctctgcctcgtatggtgggtaatcgtataggataccagcccaacctggcattctctcgcaatctgttccatgatttgggttttaccgattccgggagggcccatcagaagaaccggcctctgcctgacagccggaagcacgtattccccatgcccatcttttaaaagatatgcttctatgcagtttttaatttcttccttagccctcttgatattcatctctgtttcacctgttcatcctgattaccaacggtttgtcttccctgtcatctcttccacttccagccggatgaccgtcgttttttccacagcttttataccgaactcaaattccgtcttattcttatcataatggcgcataatagctgtcagagcttctgtcttttcctccgtaccctctactacaaaagctcttcctgtgccgcagacgctttcatacagcattgtcgaagcgcaggccggttctttcaagacaagctcttctgtcgcatacatggaaaacgcgactctgttatcctccctcagtctctcaaattttattccttccccggccccgtggaaataaagcacagtttttccatctgctgccttttcaccaaaatttaaagggatcacataagggaatgcaccgccggcaaatgcaagactgcatacgctgcatttcttcaccattgctaaaatccgttcctgctccacaaccgctctgtcatttctcctcatcccgttctcctccttctcttccaattctgctaaaccgcgcctgtgccgccgttatcaagctcctccgggccgagaatcagcttcatcgcccaggagggaacgtccgcgtcactgtagtcatctctcataaatacaaatacggtatcatatgacggcatctttacgggaaacatcccatatccgtccgtaaaatagataagtcccttaagaccggtaaaggcctttttctgaatcagggaatccacatactgaaatgccggcctgaaatctgtcccgccgcctcccagtatctccatgtgttccatataatccgccagctcctccgccgaagagatgatatgatcgctttgtatcttttcatcacattgtatcacatgtatgttcatctttgtaaaaaaactttccgcttcactgaggacagtatacgtctgttccaggaaacgccttaccagttcctccgaacaggacatggaggtgtcgatcaccacggcaaattcctctatcttctttacctcctttgtctcaagaggctcgatcaggggcatattcccgtaagtccgcagtccgtaatcataatatatataatcaaacgcgtccgtgtcaatctgtaccgtttcccgcataacggaaaattttctcagaaactctctgtaatcatactgttccctgttttctatcctgacctgcctggacagttctcccgcctcgtccgatgcctttttggaaaatgtctccatctccgtctccatcgtctcacgcattccgtcccatttgtttttccggtccgatgccatccggggcctgtcattctcatccgtccaataagaatggttatccgcataaaattcggccataagcgcaagataccgcccctccggaagtttttcctcctggaggcagcggtaaatactctgggcattcattaccccgttcttttctttcaggcgcagataacattctcttctggcaggggtctggggacggtgaaggcatttcatatccatggaatcgatcagatattccacggcgatgtcacatgccagattccacagtccttcttccctcttgcctcttgtatccatatggacaaatacacagtgcaggaccgagtgaaagtacagccggttcacaaggacgcggccggacataaacctgccggccagaaagtcaggctggtaagtgtaatgataaccgtctgtccctgccccctctgcggtaaaatcaggtacgaaattcaaggagcttaaggctgcatccataaaacgcaggttcagatacagctcgtttctggcattcaacagtatttcacggcagacagaaaccagtttctccgccttttcctgctcacaggctgccggtgtttttcgctccatatctcttctcctgacttttcttctcctgattttctttctctctggcctcccttactttctgaaacccttcatctcctaccgccacgcggataaactcctccatggtcttggtcaggtatttattccgtttcttataaaaataaacctgccgtacggccagtgattcttccatcttatagtaacacagcggaacctcataggacaggctttcaaccagggcatccgggataaatgtcgctccgattccctttccggccatattgaaggctgataccacctgatccggcttcagtgttatgttcggcgtatagttctggcggctgcacatcttgacgccgcgtttatagatgctgttttcctcttttacgaaaataaacggcgtgttcttgagaagaggcagaggcagagccgggaaatcatcgtctctgtgaagccggttcctgatgtcggccgaagtaagctgatactccttcagttccttattgatttcaaactctttcggaacagccaggataatccgctccgtgttataataatacttctcataattcttatcatccagctcagaattgtcgataatcaagtcaagctcctcacccatcagcttatccgtaagctgggaggtggttccttcaatcagctcgattttaatctggggatattttctcgaaaactctccgaggattcccggcaatataaaggaggtaaaaaatatggttccgccgatggacaatttcccggtcagaagcccgtttaaattatttaattgattaatggtattctgttccagtgcaaaaagcttctcaatggcgtcaatatagacctctccgctgggcgtcagcccgattggcgaggtacttctgtcaaatatcggacttccaatctttttctccaccttcttaatcgccgtactcagggccggctgtgtgatatacagcttctgcgccgcttttgaaaaacttttttcttcgtaaacagcatatacgtattccttaccgtcaaacatcgttcctcctgttttaccgttcttttcctgttactttaccggttgacgtaacctgcaaaaaactgcagactgcgatgcccatcctttataataaaaaattaataactattattttgttatataaatttgattatatacgaaccatgttatataatcaagctaaagaaaacaattgaattatttttttcggctttataactcaaaccttttcctctccggaggataggcccggtaagacgcatccatcagaaagcttgtgacttccgtacattctgcctggtttgaggcttcaatcagtttagcaaagccggttttccccaaagccggtttctttatatcggaatattcctcgcgagcacgcactgcataaccctcgttccccaaacaacccgcagctgcgtgctcaacctttatcattttttccccacacggcgtaaattcaccgacaaaccatctccagtcctccatgctgtcatttttcaggagacaggcagcggcttctacaggatgctgcaccagatattcacgatacgtcacgctggcttcctgtgaaagctccagaggataccgcagacggccgagagccaggactgccgcctgctgcggggattcctgggctctggcatggataaaaagactgtcatattccctgaacttaaattccgttccttcaaatgcatagcggtagcggtgaccgcagccatgaacatgagtttccaggattctggccggcgtattctccacagcctcctcataaaaaacgggaaacaaaagctgcgccctgccggtgcatttcagttccccatccccgctcttctcatactgccggtaaaaaaccgtcagcgattcattcagctctgccaaaacctctttcaggcaagagcgctcccctttaatcacaccgattgtcagctcatcgatttgacggcagccgttaaaagctccggcgccaatatctacggctgtggagaacatggcaagctttttaaggctgtagcagttataaaatgcatacctgccgattttctttattgtagacggaaggcatatctcccggacgcgggaaccgcaggccgccgtgttttcatctgcgcagcgttcctccgaagtgccgttctccgtccatattttcccctccggcttgtgccgcatatcctctgagaatatatagtctcccagctccgtcaccttttttccgttaatagactcagggagtacaatccggccgtactccccatagcatcttagtattgttacagaatctccgttttctttatataggcatttgagtcccattctcataatctccgttccagaaaatcgattatacccttcaggcaggaaatcagctcataaagccccggctttaccgtccatatcaaagagtactgctcttaccttctccatgctcccgtcctccgtccagaacccattccttcagttcattcccgtcgtagtgaagcttcagcgaaaaaaagtcttccctctcaagcaggagccggtgaaaaattttatctccctcccagaggttcagcttgaacacatcttcttttttgacccattcaagcgtaccctcgtcacacgcttttagctctcccgtaaatccgtcggcagtgaaaaggcagatatactccatcggccatccctcggcaataaaggtcaggatccccctgaacttccaggaggtcagcgtcagccccgtctcttccttcacttcccggagcaggcattcctccgggctttcatttttctcaaaatggccgcccacgccgatccatttatccttatttacatccttgtcctttttcacacggtgcagcatcagatagctgccgtccttttctatatagcagagcgttgtcagctctgattttttcctgtcctgcataaactatgccttcctcttttctgaattgcctgtccgccggttcacgggcgtcaatagtgaatcgtcaggtgagaaaaatctttcgcatcatcctcgagtatattcctcagaaaatcgctcagatcactcacgtaatcaattgaagtccagtattcatacgctttttcgttctgtaccgaatcggcaatctcaaacatcctcccaccgtagtagtatacgcagagtttcgcataaaatctggccatttcatcaattttttcatcactgaaaaacagtctgcgctccatcgtatgctttctgagatccagaactgcattcctgtatgtaacctggtttaaaaaccgctcactgaaggtcctaaaatcagccaaatcgcggtttttatatgaatttctttttgcccatccgtctacatccgccgatttagcattgtactcaatatctccgctgttccagattttcaaaactccgtaatgacagggggccatcaccagggagcctgtaacaatctcgctgattccgttatcttcatcttctttataatgctgcagatggagatgaccgctcagatgaagccggacatcgtaatcgtacagcatacggatcatttcctcgttgtgttcgatggtgcagtcgtcatagaactccctgctgaccccgctctgatccagaagattgtggtgggataccgtgataacctgggcgccttcctcccaggccgactcaagctgtttttccatccagtcataggtctccccgcgaatcatgcccccaacgcggttgaccggatcatactggcaggaatccagcattaaaagccagtaataatcgtccagcttgtaaagatagctcagcgatgcgggatcccggctgtcggccgccacatacccaaaatccgagtagatttgggcaaattcgtccgccgttatgctatcggtctttacagtaccgtccgaagtaaacttccgcgcatacggattgttgatatcgtggtttccgggaattactgccacctctattccattttcgctcagagtctccagcttttgcgccagttcctcatggctttgcttttctccgttcattgtcaaatctccggtgaggatgaccagatccggtttctgttccactacatcatcgataaaggcatccagaatctcccagccgtactgaagtacacggccgtccccggattcaacggaagacataaagctctggcacctgtttcccgccagctcctccgccagataatggatatccgttgccacaataatcttttgctgaacgaaagtatccgggtcgtcgggcaatgtctccctcgtctcctccgtactctccggctgcgtttcctttcctccgggccggctgccggatggggcttcttccctgctgctttcagggataatttcctgcgtctcctgactaaccggttccgtcagaccttcgcttcccggctgttcagaaggaacatccgaagtctgagatgcacatcccgccgtccccatcatacacagggcagctaaaactgccgcccacttcctgtaccttttcatccgactttctccttctcatgtatgatgcggccctctccgaaaccattgttgctgtttgtaaaccgtaacaaaccatttcctacagtacataactgtgatcaacctctatcaccgcataataattatcccatttctggcttatccgtttccgtatttcatctgtgacctctttatccgacagcttcagggcaaacggtattaccacatcgaatatcagatttgtatgggtcggtcccttcaccattctgaaatcatggatgctcaagtcctcatggatatctttgcagagttccgcaacgcttcgcctggttatgttaacctcctcatcgtcggttgcgataggatccatatgaatgaccgcgtcgcagcccagtttgtctttcagctccttctcagcctggtctatgacatcatgaagttcaaatatattgccgtcccccggcacctccccgtgaagcgatatcatcagtcttccgggaccgtaatcatgaacaaccagatcatggattcccacaatctcctggtgggacagagtgatgtcccgtatctggcttatcagttcctcctccggcggctggcccagcagcggacttaaggtatccttcgctgcgctgtacccggcatagaggataaacagagcgaccattgcgccgcaccatccgtccacattcaatccggtaaatttaagaaccagcatcgccagaagcacaaccgaggttgccaccgcatcgctcaggctgtctatggccgtggccttcatggcggctgaatcaatctgttttcccacgaatcggttataactgcacatataaagcttcacgcacacggaaaccgccagtatcgcgatcgacatcatgctcatatccaccggtgacggggagataatcttggaaaccgaagactttgccagttccacccccatcaggataatcgccgccgatacggcaagccccgatatgtattcaatccttccgtgtccaaacggatgctcggcatccggcttcatccccgcgaacttgaaacctatcagagtaatgagggaagacccggcatccgacagattgttaaatgcatcagccataattgcaatggaaccgctcaaaacaccggccagatattttccggcaaacaggcagatattaaggccgatccccaccgagctgcacagagtgccgtacattcgcctcacggcagggtctttcacattatcagaattttttattaaccgctttattaaaaattttatcattattcatcctcatctgttttaattcgtaacggttcagtcagcatggactgttactctaattcacatgcccctgcttatttttagtataggaaacgtcaatttttttgtcgtttactataaatacatatcggctctcatcagacagctccggcatataggaaaatcccagcctgtcgaattgtttaaccgtctcaaatcccatggcattctgctcagcaaggaaacgcaccatctctcccctcgccatcttcgcttccgtagcctttaccttgaccttaccgtctgtaagcgtaccaaatatacaagtaacaaactcgtcccccggtttcagccacggttccaccgccttgctgtattcttttgaagcaagatttaaaactttgcaccgcctcccggattccccgtcaggccggtacagctctctgtatattgcatccttccaataaccgtacaaatccccggctcctcccgccgccagcctggcctgcatctcaagcctgtatggaacaaccgcatcgtccgctctcaggattccgtaaaagccgctcagaatccgcagatgtcttcctatgtaccgccactgttcttctgaaaacagatggggagccatatattgatactggatcccaacatatgaaagtgcggcgggtgtcaggtttctggtcagatccatgtcccggtagcgaaggtaattttcatgggtaatggaatcatttgccgaaaaaagctttttcaattcctgctctgaataggactgcagcttttctttcagcacctgcgtcctgtccaaaaaaacaggcatgtttttccagggcagataatccgtcctgacctgcatctttttggcaggggatataataatacgaagctccgccgccagagcctccttcttgttttttgtcatctttttaattgccgcctcccgtttcatggcttcctctttcgtattccaggcctcaaagtaggcaagggcaaccggccgcctgctcttcgtatatttagcgcctttccctgaattatgcatctttatccgctgttccagatggtttgtccatccgcagtaaagcgaatcatccgcacagcgcagaagatatgtgtaattcatcctcttcctccagacggggtatgtaaacggtaacaacaccttgcaatgtgccgttaccgcccaaagctccggggcgcctgacggcacttccacaaagcttcgtatctatctaaagcatcggccggatgcgctgtagccagttacgaatcacaaaaactgccctgtaactgttgccttcctctgctttggctataatctattatatggattttctccggaaatgcaactttcattccggcatttttttccggctgtcaaaataaggaaagctgtcaatgccatccagtatgtcggaaaactcgtccctgggggccagttcgatatactgcttcagtatctgcctttccttctttttatagcgtccgtaaaaaatatcgtagaggttgtggcctctcatatggatcttgaacagctccatatgctgcttcaggtcgtcctccgaatcgggttcgtgtcccagcgcctggacaaatttttttcctgaacggagccgtccgagatattctgtccatttctgccacagaatatgataaaaatcttcttctgatttcacaatcccaagctttgtcataatctccggatttaggaaataattttcaaaagaataatatttcagaattaaaacattcttacgtgtcacgcgcggcagtccgtccacatccctcagattctgttcgtcatagtaacggcacagcccgccggccagttcctccggatcttttccgtcaccgtcccgtatcatcaggaactggtcctttaaatagacctggttcatatattttaagttggcgtacgtctttatattcgtacagctgttggtagttataatggcgatcctggaaagggtgccgtcactgtcatggacctcggaatagtatttttccaggagaagcggaaggcggctcttatcctgctttccctccacgatgaatacaaaatcgacgttcatggcatcggctgccccatatcccaaatcatcgagaatttctccgatatccgtatttctcctgataatggagtaatattcatcatccaatactacctgccggatctgacggttggtgaagttcaaaagaagctggggggagtgggtgctgaacagaacctgattcttcttggacagccggtacaaaatctcgctggataccttctgaagctgcgggtggagaaacaactccggatactccacaatgacaatgctcggcatcctgttctctccctcaatatatgtttccagcagggacagcatgtagatactccgcataccttttcccatatgctccaccgtatccacctctttgcgttcgctgttataagtcttcacctcaatctgaaacatctgatcgatatcacagcgcagttcatagaggatatcgtcatatcccccgtttttatgaaaattgtcattgatgcgtcccacaagatcgcccatatttgactgatacagcttatattccagaagctttcgtgtctccgccgcatccagttcctccggctttttctggttgatcagtccgatacactgaaagcagtgtctgcactctttagccgcatcaaagagacagcggccggagcgcagctggttcataatccggttatcatggaaaagcagcagatcattctgaaaggcctgaagctcccttgccgtattaatataatgcagtcttggaagcacttccctgatgcaggggttatctttctttatcccgtccgtatagcggaccgtcccctcataattggccgtataggtaaattccagcaaatctcccttacaggacggaagcttccggtagaaatcattttcccagatttcataccgtttataccggctcactattccggcccggtgcatcattctccgatcctccggcgtaatctcaagagtcacctcgatttccacattctgctttgcttcattaaaatcggctttcgtaagctcctccactcctgatacaacccggattgcatcaaggaccgaggttttacccgtattattctttcccaccagaatcagagcgttttcgatatcacaaatctccatatcacgtatcactttgtaatttctgattctgagacgtacaagctgcatggtttgcctcctttcggccgtttaatgcaaaatttcctatattttaacatattgtaaatagactttccatagtaattggagatttagttaagcaggtgaggacgccgccggtacggccagcggacggggtggtggggtgtgtatatgagtctttcgtcccgggggagaattgttgtggtttggggctgcgggcgaagataaagtctgcggagcacgctcccgctctgtgaaatgcatcgcgctgctaagctcgacaggacctcgctaatcaacgatggatttaggcggcatccgcagactttatcttcccctccgccccaaggccatgttttcgccgggacgaaagactccgccgggtgtatcggccccgtccgctggcctgccgccgctgattgtctcacgcgttaagtgcggagggcggaccttgtcgagaccactcagagctttcgtgtgcggaaaatatgatatgccttaaatgcgcccttatgaaagaattgcggaaggtttgatttcagtttgccggaaatacgtagtggccgcgacaaggccctccccatttaaggttggagacaatcagcggccggaacggaccatgtccggtgccgcgaaaaccttcgcctgagtcttccgtccccggcgaaaacctgaaccggggaagtaggcggaatcaattgcggaggggacatgggagtccgccggtgcttagcgaggtccctcacgagcttagcactgttgcgtactccaaagagtgcaaacggtccccgcagcaatccattccggccggattcccccctcacgacaacctccacccggggatggaagactcagccagtcccctcaccgcaccggacatggtccgttccggacgcgtcctcctaacctccgttaaatttccataccacaccaaattgagcggaattaaaaccggtgatattcttccggccttaattccgctcaatctattataaacattaaatatagcaaatttccaaccaatatactcatacaactgcatcagcccatatccaacatatatctaacggacatggaagcactgagtgcccgcgacaagatactcccccacacttaacgcgtgggacattcagcggccgtaccggcggcgtcctcacctagttaactaaatctcttttatcagcacaagtttatccccaggccgaatctcgtcttccgtcagtccgttcgtctctttaatattatccacagtggtgtggaatttctttgctattttccacaatgaatccccgggctgcacaatataacccacaatccccggcatctgctgcagcttctgcatatccagcggctcgaccttgaccccggttaccacctgctcacgtataggctgcagcaccagcaaatccgccgcgatcacggcttttacctcgactgaatcgcctcccagcatgactgccgtaagctgctccagccccaggttcatctgccagatactgtccgcattgataccgtcggcctcagccacacagtggaacggtaccatttcggttgtagctcctaccggttccgtatcatcgtccgtcagatataaaagattcacctccaggacgccttctatatgcagtccgtcctcccttgcctccgcttcatccagcttcacgctgccgctgctgtggcaaatctggagaattcggtccggcttgctgatttttaactgttccgccactttgcatttgcagatatttctggtcagaaggcggtcgaaacaagcctcccccgtatccagcacaagttcccggttggtggaatagagatcgcttaaaagctctacgttctcttccttatagagcttcatatccagttccaggacagcgtccagttcaaattcccgcatttctccgtcatagtccggtttcatctcgatgccccggtgcagaatccgcacgccgatcgccgggatcatctcctcctccgcttccgaaagctccacatcccccgaaaatggaagactctcctcaagccactgaacgggcgtatgctccccttcccctgcatagatgataaataccatcagttccccttccagatggatatttccgtccatagggcggcaggtaacacctctcagcctcatctcattccaaagaatgctttcgatattcggtttatttcccgacacctggatatcttccttaatccgatgcgtatcttttctgcgtaccgcaatagccgccacatcgatacttctctttaatacctccacctcttcatcatctgtttcgatatccacggccgcctccgcgtcatacagattttctacccgcacttccagtgtcacaaccgccttgatgctcagctttctggaattgatcatgctggtattcaaatcctcaagcgtccatgatacctgggtataatcatgttcatccagatccgggacgttgaccgtctcgtcaaacggcacttcacctcccagagcctgcagcccgccctcagcttttctgtacagcacacggaaagccagtttccccttaatcaggactttatccccctgggttcttgaagattcgatctggatctcgccgttatccagaagaacctgggatacatcgtccatcgtgtccgggacaataaaatcatcatccagcgtaatctgggataccgcattccctttctgtctgttcatatgtatattttttttcatcagctccatcattaatgatcgcacctgccctttccatatctacaactttatgaaagtttatgcggacagacgtgacaatattccaaatatgaaaaccggcgcggccaatcttcccctgccgccgcagtgcgatcccccgcggagcggttttaatttaacaggtgaactttctgttaaattaaaaagcaccggttttcataccgatgcttttctgcctgactacaaatccggcctttattctaatattcttcgaggaaatgatgtctctccccgtctttgacgtatccgatacaggcatccaggttaatattctcgacactcttgaaaatattcgtctcaatatgcggattaatccgccggaagctgttgattaactccttcatttcctgtctcttggacaggtggttttcatctctccccgcgacggcctcagccgcctccgtaaaccggcaggcgcactggaggaaccggaggccgttgtagtccttccataccagtatatcggcttccttcaccagataaaggggcctgataagctccataccttcaaaattagtgctgtgcagcttcggcatcatcgtattcacctgcgcgccgtaaagcatactcatgagtatcgtctctatcacatcgtcaaaatgatgccccagagcgatcttattgcagcccagcttcttcgcgtttgcataaagaaagccccgcctcattctggcacacagataacagggggactgatccacatccactactacatcgaatatatccgagtcgaatatagtgaccggaatattcatggttttggcattctcttcaatcatcctgcggttggccggattatatccgggatccatcacgagaaaatgcagcccgaattccatcttcccatgccttaatatctcctgcatacatttggcaaggagcatggagtccttgccgcccgatatacagacggcaatattatcgccctcttttatcatatcatattcattcagtgcctttacaaaaggacgccatatttctttgcggaaccgtttgataatgcttttctctatctcacggcagcggtcaggctctttttccctcatcgtttcattcctggtctcttcactgcattttattgtatcatgctgatctttgtctgtattctgcataagccggctgcttcctctaatccttctatcgttctgtttctctcttatgatgcactctcagctgcttcggacgtcccagcggccccgcctgcaatcacaggaggtacggttgttcctgtcgcctcttccagcgctttgcggaggacctcaacttctttctgaagctcctccagctgctccatcatctttctgttatgctcacttatgattgttttcttttttttctcaatcggcacgccgtctttctttaccggccgggccggaattcccacagcggtgatattctcatcgagctggcgcagcaggacggcattcgccgcaatcgaacagttgtcgccgacttcaaaggaaccgagaatctttgctcccgcgccgaccgtcacattattgccaagcgtcggatgtctctttcccttctgggttcccacgcctccgagcgtcacgccctggtatatcgtacagttgtcaccgaccaccgtagtctcaccaatcacaaccccgcatccatggtcaatcaatatcccatgccccagctgggcgccgggatgtatctctatcaaagtaaaaaatcttgccagctgcgaaatcagcctggcgataaaaaacatatggtgcttataaaaccagtgggcaaccctgtgccaaatcagcgcatgaactccctgatataagagcagcacctccagcgcattcctggccgccggatctctctcctttacggctttcacatccagccagatatccttaagaatcattctctcctacctctttttcattctgtctccgcatatgtccttccaatgagtatctatggggtgaagtatatcttattttattctatgctgtcaagtagcgtgcgccagagcgtgattgaaaattctatggagatttagttaagatggtaaggacgccgccggtatggccagcggacggggtgagggggaaatgagtctttcgtcctggcgaaaaccagaccttggggcggatgggaagataaagtctgcggatgcggacatggtccgttcctaacgcgtccttcatcctcaattacacctcacgtaaaagacagaaccggaaaataagagttatttccgattctgtccatataaatttaatccctgtgccaaagcctgctctgcggtatgccggacgacggtccgccaggcgcgccgccgaataccgtcctgcaaagtctcacatactcctgatattccggataatctcccagctccttcagcaaatcgaccatggagttataataccaggcatgcttatctttttccttcacattgaagcgctcccaaatattctcaccctccagcagatagtctcttgccgtgctgcggatattgctgagtttgtccgccaacgtgagtatcttaatctcacgccctgcagaacggagatgttcaatcgtccggctttttctctccatccatgttttggatttgtcctcgctctcctccgccaccagatccgcaacgtggctgccgaaatgttttttcagctcctcatagctcactccggcatcctccatcgtatcatggagcagagccgccgcaatcagttcgtcgtcatccgacatcatcgatgttataacggccgtctccagcggatgggtgatataaggtatatcagaaccttttctgaccgccccccgatgcgctttttccgcaaattcagctgcttcccttatcatcggaactctccttttctgcacgaccgcgattgcgccggtaccctaaccgtcatcgcggacaatgtgtatatccatctggttaaatggaatgtcgattccggcctcgtcaaacgccagttttattttctctgtaatgtcccatttagcagcccagtaatcatccgccgctacccagcctcttgcaccgatcattaccgagctctctcccaggctgtctacaaacaccgttatatccggatctttcagaaccgcaggatgctctctgtaaagtttttcaaggattgtttttgctttctttaaatccgaacggtacccgatcccaaccgttaaatcgagccgccttctttccatggccgttacattggtgacggtcgagttagccagcgtaccgttaggaattgtaatcgccttattgtcaacggtcgccagagtagtatagacaagtccaatcatcgaaaccgtgccttccccatgaatgcagacaatatagtcgcctactttgaagggcttcatcatcagaatcagcacgccgcctgcaaaattggaaagactctgctgcagggaaaggctcagcgccaggctggccgtacccagaaccgccaggatggatgtcgtattaactccaagctggcccagaataataaacaccagaagcgcatacaggctgaattccgtcagggagcgcaaaaatttggaaactccgatttccactccggtccgttcgaaggaagcgctcatcattctctgtacaaagcggattaattttcttcccgccagaaataagataagtgctatgaacagtttccatcccagagacataaggctgggtcccagcccctcaagcatctgctttatcatcccgggcttaatctgactcagctccgttaaatctctctctgccgcctccactgcatccgccgccgtggacgccgcggccaataatatataatgtcctgtcatccggtatctaccgccttatttctttgttctctttttcagcggtatcacatccgccggttttctttccggttccgcggtatttccttctgcccggatctgcgcggcttgtccggtttcatcctgcttccccggtttcccggcgggcgcggcgcctgcagtgcgggacggctttttattatggctcttatccgtattttttgcggaacgctttcccgtgttcttggcagccgccttcttctgaaccggcttcacagccttttcaggcgtacaactgaaaatgcagatactcatcggaggaacctgaaccgttatggcatgcttcctgccgtcgctgtcttcctccctggaggtcttcatgcgtgggtttccctttccgcttccgccgaatttaacggcatcgctgttaaagatctccttatacttgccctcaaacggcactcccataatatatttttcatgaagaaccggggcaaagttacagataaagagaagcgtctcctctttcttatccgtttttctgataaaggatacaatattattagcagaatccatacagttaacccactcgaaaccatcaggctggtaatctttcttatagagagcagggtatgaccggtacagatgattcagttcttttacgtattccttcatcctgccgtgaatcggataatcaagcagctcccattccagctggacattctcattccattcatccagctggccgaagtcctgacccataaacaggagtttcttgccgggatgtcccatcataaagccgtaagcagtccgaaggttggcaaatttatcttccaggctcattccaggcatctttcctgccatagagcctttgccgtgtaccacctcatcatgggaaaagacgaggatgaaatcttcactgtatgcatacagcatgctgaaggttaattccttataatgatggcttctgaaatacggatcatatttcatgtattccaggaagtcattcatccagcccatgttccatttataatcaaatcccaggccatcctccttcacgcttccggtaatcttcggccatgccgtggattcctcggctatcaggatagcgccgtcttttcttcctttaaagattgagttcagatgttttaagaactcaacagcctccaggttttcgtggcctccgtagatattagcaacccattctcccgggtttttaccgtaatccagatacagcatggacgccaccgcatcgaaccggattccgtccgcatgataacggtctgcccagaacagcgcattcgcaatcaggaagttggaaactcccggtcttccatagttatatatcagcgttccccaatgggggtgtgagccttttctcggatccctgtgctcatagacgcaggtgccgtcaaactgggccataccccaggcgtctctcgggaaatgggccggtacccagtccagaatcactccgattccctggctgtgcatataatccatgaaatacatgaaatcatccggggttccgaaacggctggtgggtgcataataccccgtgacctgatagccccacgaggcatccagaggatgctccatcacaggcatcagctccacatgggtataccccatctctgtcacgtattcggccagctttttcgctatctcacggtagttataaaattccgaaccggtaataacatgtcccgtatcgtcagtctttgtctcttttctcatccaggagccaaggtgtacttcatagacagacatgggggcggtctttgtatcggtcttcgcacgcttgtccatccattccccgtcgttccactggtactcgttcaaatcccagacaaccgatgccgtattcggcctgagttcggcataattggcatagggatcggctttgagcgcaggatctccgtttttaaacttaacttcatatttataaaccgcgccttttttaacaccgggtataaatatctcaaaaatcccggactcgccgagctttctcatctgatgcctgcggccatcccagagattgaaatcacccacaacgctgacacgcatcgcacaaggcgcccatactgcaaaatacacgcctgccgttcccttaaccgtcatcggatgagcgcccatcttgttatagattccataatgaattccagcttcaaacttctttaagtcggcgtcggtgaactggggcgcaaaagagtatggatcatggatttcacccagggtaccattatcataaaataccagcagcgtataatcagccatagtctttctcggtatcagcgccgcaaaaaaaccggcatcgtcggccagctccatctggtacgtctttcctgtcgatgttattttaactgtgatatccctggcagtcggaatgaacgcctgtaccagcattcccgcctctgtcatatgggcacccagcatgttgtgcggattggaagcttctgaatataccagttcctcgattccggcccagtccatcaagtcgtataatgctttgtccataaatacgcctccttttcttcctacctgtttttaaagtccctgtcctccccccgtttacgaacagttacactttatttcattctatcatcatgaattgaataatacaatctttttaccctaattttagaattggcaatataaggcccataactgatcagacggggcgctgttactaaaacattaggagaattagttaagcaggtgaggacgcagccggtacggccagcggacggggtgctggggtggttttatgagtctttcgtcccgagggaagattatcgtggtttgggactgcgggcgaagataaagtctgcggagcacactcccgctctgtgaaatgcatcgcgctgctaagctcgacaggacctcgctaaacccccatgcctctgatgcggcaccaccataaatgaaactgcgagggcggcaggtgattgaaattgctgttgattgagcttatactgacattaacggcaaaaatcggcactaatttgggcctgtagcccgttcgctaaactgattttaggtactctcatttgcaccaccatctgtccagccgcttgcggcagaaggacgtacagtaaaataataatagacagagtaccgtgccgtaaattttattttggaggtaaccatatggataaagtttacgacaaatgttgtggtattgacgtgcacaaaaagctcatcgtcgcctgctttagaaaaggcagcaagcaggagttacggaactttggtgcaacaaccagagagcttcttgaattagctaactggcttcagaacggtggctgtgaaatggtcgcaatggaaagcacagcgtcctattggaagcctctgtataacatcctcgagtcttctgaactaaaggctatggtggtgaatgccagccatatgaaagcagtcccggggcggaaaaccgatacaaaggatgcggaatggattgcggagcttcttcagcacggattattaaaagccagttatatcccggataaacagcagagggagttaagggaactggtccgctaccggaaaagcctcgtgagtgaacgcacccgggaattgaaccgactccaaaagatgctggagggtgccaacataaagctgtccggtactgtatctgacatcaactgcatgagtgcgcgcaacattctggaataccttctcaccggagaattcttcgacgaagcaaagtatgatgaaatgtataaacagaaaatcattgcccacaatctcaaagccagcaaggaacagcttatcgatgatttaaatggtgtcatgaccccattacaacgtcgaatgatgaaagagctgctgtcccatctggatgaactcaatgttcatatcaacaatctggaagatgagattgataactttatgaaaccggaagaaaaaaaaagcgacacaagcaatccaggatgtaactggtatcggaaaaaacagttcccaggccattatttcggtgattggtacagacatgagtcgttttccaacggccggtcatcttgctgcatgggcaggactatgtcccggcaataacgagagtgcccaaaagaggaagaccggaaaaatgcgaaaagggaatgctcttttacgttcaaccctggtagtctgtgcgcattccgctacaagaaataaaaattcgtacttttatgcgcagttcatgagaatcagttcccaccgtggaaaaaaacgggcttatgttgcagttgcccattccatgcttatagccatctatcacatactcaaggatggagttgttttcaaagatctgggtgctgattattacaaccaattcaacaaggaacgtaaaattaatgcgtacctaaagaagttaaaagcgcttgggtgggaggttccggtagttgccgcctgaacctgttagctgagttcaaaataaacgtcaaaaaggttgatgggggaagtctgcgcttttttggcttcccagaagttaaagtttcacagtaatcagcgatgaatttcaacggcatccgcagactttatcttcccctccgccccaaggccaggttttcgccgggacgaaagactccgccgggtgtatcggccccgtccgctggcctgcggccgctgaatgtctcacgcgttaagtgcgggggcggaccttgtcgagaccactcagcgcttccgtgtgcgggaaatacgatatgctttcaatgcgcccttatgaaagaattgcggaagatttgatttcagtttgccggaaacacgtagtggccgcgacaaggctctccccatttaaggctggagacaatcagcgtccggaacgggccgagtccggtgccgcaaaaacctccgcctgagtcttccgtccccggcgaaaccctgaccgggggaaggaggcggaatcaattctggaggggatatggaagcccatccgtgcttaacgataacctgtacgctctgcgcacaggtcaccgccttcaatgaggtttctcacgaatttagcacggctatgcgcttcgaaaagtgcaaacggtccccgtaagaattcattccggccggattcccccctcacgacaaccttcaaccagggacggaagactcagccatccccctcaccacaccggacacggtccgttccggacgcgtcctccacacctcagttaaatctccaatcaggtctcagtactcccgtctgaactgttactaaggccctgaggagggttcctccgactgataccatgcgagcatcagatctaccgccctgccgtagcttctcaccccgtcggactggctgttcgcttttaaatacgtattatttaacgtctccgccgcttttgacaccttcgtatcaaaccggtcccaaaatgccgtattttcgcgcagatcctcctgaacctccggtcgcagcatgtcccagtatcctgcataagcctcgtgatccaccgactccagtgcatttcctgcgtaaatccatcccatcagatagccgctgtaccggtattcctgattctccgatccaaagcatgccagaaatccgatgaagttggcttcatcctccctcataaaccctctcagatgtgagagctcatggcatgcagtgtggggaatattataaggcgtcatctctgcattatagttggcttccaccgtaaacggggagtaaatgccgctgagctgctgtattgaaaggagccttgaaaacagaacgggtttgggctttgggtaataaccggcaagctggggatactgttctcccagcttttccatcgccttcacagcctcgttctgcaccttccggcgctcctgaccgcccgtctccgtgtaaactgcgttcactctctgcgtcagccatccaagcagttcctccagctctttttcagagtatcttcctgccctgtactccaggtaatcggaaaatggacggcggtagtaattaattccgcagttgaccgtatagataaaaaagagcagtgaaatcagaaaaagcgttccggatactatctttttccactgccccagatgacaaaagccgtataaaacgcaggagataagcaggaaatagagaagaagctcaccgaccgggaaggggaacaaaccaaaaaagcgggctaaagtccctgaaagccagggataaacccactgtgcataccattgtccgaaccagccggtctttcttgccagaacctgcaggacggcagagattataagaaggcctcctccggccaaaagcagcctcatttccctgtttttcctgtttcttcctcccatatttcaccccttcgtcatgaaaaactgaaaaattccttatcatttgcgaaatttctttaaaaaaacttgataaatcaaaaaaactcatatacactattatattgcaaactaaactcattcgtcaaacaggagataccatgaaaaatatagaagaaaataaaccggaggacccccagcagccggaagcgcccggcgctctggcagaagaactggaacgggaactgacaaaaaatacggtcggcagtgaaaccggtggctgggaggcggatacaggcaagccgtcaaaagataaaaacggaaaagaaccatttaactggaaagccgaaattataagctggatacaggtactcgtcacagcggctattatcgctttcgttattgaccgctacattatcgctaacagccaggtgccgacgggctccatggaaactacgattatgccgggcgaccgggtaatcggttcccgtttatcctacaccttcggcgaaccggaacgtggtgatatcgcaatctttgtctatcccgatgatgcgtataaagggattaccacctactatgtcaagcgtgtaatcggaatgccgggcgacaccatagatatcatagatgggaaaatctacattaacggttccgatacgcctctggatgagccctatctccatgaagagatggaggaagagccgccccagcactatgaagtccctgaaggatcctatttcatgatgggagataaccggaactactccaatgattccaggcgctggaaaatcaaatatgtaacggaggatcagctggttgccaaagtcctgttccagtatttcccgaaaatcaggaaacttgaatagagcatccgtgataaagatattaaaatagctatcaaaatattttattaaaatagtaagtgattttttatcctacaatacgagggaggaacttatgaaaaaagttgtgaaattcggcggcagttcccttgccagcgcgaagcagtttaaaaaagtaggcgaaatcatccgttccgacaaggctagacgttatgtcgtaccgtctgccccgggcaaacgcagcaaaacggatgaaaaagtaacggatatgctctatgcctgttacgatgcggcatcaaccggcgcaagctatggtaaaatcttttctaaaatcaaagagcgctatgagcagatcatcgaaggcctgggactcaatctgaacctggattttgaattcaagaaaatcgaagaaaatttcattgccaaaaaaggccgtgattacgctgcctcacggggagagtacctgaacggaatcgtcatggcaaattacctcggttatgaatttgtcgatgcggcggaagcgatattctttgatgataacggaaattttctggctgacaaaacggatcaggaattatcccagcgtcttgaacatatcgaccgtgccgttatcccgggcttttacggctccaaaccggacggaaccattaaaaccttttcaagaggcggctcagacgtcacaggctccattgtagcgaaggccattcacgccgatatctacgaaaactggaccgatgtgtccggattcctggtgaccgatccgcgcctcgtggagaatccggtgccaatcgaaacgattacataccgggagcttcgtgagcttgcctatatgggagccagcgttcttcatgaggatgcaatcttcccggtacgcaaggaaggtattccaatcaacatccgaaacaccaataaacccgaggatcccggcactctgatagtggaaagcacctgccgcaaacccaaatatgttatcacgggtattgcaggtaaaaaagggttctgttccataaatattgaaaaagccatgatgaactccgaaatcggcttcggcagaaaagtgcttgatgtttttgaacagtatggaatctcgtttgaacacatgccttccggcattgataccatgacgatttttgtgcatcaggatgagttcgtggactatgagcagtctgtgatagccggaatccaccgtgcggttcagcctgattttgtagatctggaggctgatttggccctgattgcagtcgtgggacgcggaatgaaatctgcccgcggcacagccggcaggatcttctccgctctggcccatgcccgtgtcaatgtcaagatgatcgatcagggctcaagcgagctgaacatcattatcggtgttaagaatgatgattttgaaccggcaatcaaagcaatatatgatatttttatcacggctgagatttaagaaattaatagattcgttacagcagttcgtagctgccgatacgggaaggaggctgatcatataatatggtcagcctccttcccgtatcgcacattcataccgctctgcggcatctccatcgaattttaatttatgctaaatcagggtatacagataaaatgccatacacagtcccaccacatacatgggagtggggatttccttagccctgcctgcggacagcttgaggaccagatatgtaatgatagccagtgccatgccgtttgcaatgttataagttaaaacagtcatagcaacggcaacaaacgcaggaaggtattctgttttgtcatcgtaatcgatccctctcatggagcccagcatctgaaaaccgataatagtcaggaccggtccggtagccactccgggaaccatcatcgccagcggggtaaagaggagcatcagggcaaacagaatgctggttacaatggcagtcaggccggttcttccgccgtcctccacaccgctggcagattccaggtatgtggtcataaccggcatacagaaaaagcttccggctacggttgagagggagtctaccttaaagcatttttcaatgcccggcatatctccgtttttgtcaagccatccggcctgattggcaacacccagaataatacccatggtaccgaaaaagtccggaacaaagaacgtcagaagccacggtaaatattccggcctcagcgcacccagaatatcaattctgaatgagacatcgcctataccgctgggaaggttcagtaagcttgtgggcagtgtggtcacccccaggggaactccgattatcgttacaataagaatagaaagaatcatgctgcctctgattttacgcgcctcaaatatcagaacaagcaaaaaaccaatcccaaacatcagggcttttgccgtacctaaatcgccgaaaatcagggtgtttttgtcactggccataataatgccgccagatttcaaaccaatcagcgcgatataaaggccaatacctccgctgagagaaatttttatactggcaggaatggcggtagcaataatctgccggagcccggcaaaggaaataattacaaaaatgacaccttcaataaaaatcaggccatatgccacctccacggtcatattcatagagccgacagaactgaggatagccacggaactcataccgggagccaggcaaaacggccggttggtatacagcgccatagccacactgcatatgaccaccgcacagataagcgcagttaaaatcgctcccctcacaagtcccgcctgctccagcatattggggatggttgccagaacataagacattgtggcaaaggtggttacgcccgccagaacttctgtctggatattcgttttgttttctttcagcttgaatctgctttctaatacattgccaatactactcatttgttccctcctgttgttaatcataatctgaatccatacttgagcctcagcccaggtttccagccgcttaggacattacagttcacaggcagtatcccgcgaagaaattaaaaaacctgtttcacacaaatatcccgggtcatacagtgcaaaatagctttttactgctttttgtgcatcgcggtgcgcgttattgtaacttaagaacagctgaactatatgtaaagagaaatgaattaaatttctctcacaattaaataaatagcagatatcaggccagggtagtgagatagtaaacgaggaatatggaaagcccgtataaggaaacgtgaatttctctccatttaccgacggcggcttttaataacacgtaggacagaatggaaagagaaagaccattggcaatattatttgtaaaaatggtcatggacaccgcaataaaggccggtattgactctgttttatcgtcataattaatatttttcatggaattaagcatttgcaaaccgatataggtaagcacaggccctgtggccacgctgggaatcatcagagccaatggcgtaaaaagcagcatcagcacaaacagaactgaggcaacgatggatgtcattccggtccgtcctccgtcctccactccgctggcggattccaggtacgtcgtcataaccggcatacagaacaggctgcctgccacggtggacaaagaatcaactttaaaacatctttcaatccccggcatgtttcccttttcatccagccattccgcccggtctgccactcccaggaggataccgatcgttccgaagaaatccggaacgaaaaatgtaaacagccatggcaggtattccggcttcagcgccccccggatatcaattctaaagacaatctccgttacggacgcaggaaaattgatcatagtttccggcacagtggtgattccaagcggaatgccaagtaaggttaccacgagaatggaaacaatcatgcttccgcggaatttccgtacctctaatagtatcagtacaacaaagccgagtacgaacaaaaatactttcggagaatttaaattgccgaacgccaaagaattggagttcccggccaccacgacatcccctgtctttaaccccatcagcgcaataaaaaggccaattccggcgctgatcgaaaatttgacactggcagggattgctttgaccaccaattcccgaagaccaacaaaagaaattattacaaacaaaacaccgcttaaaaaaatcaatccaaaggctacctcaaccggtatccctgcttctccaaaaatagaactgacgatagccacagaactcattcccggagccaggcagaacggccggttggtatatagcgccatggctatgctgcaaacggaaatcattataatcagtaccgtcaggacagctcctttgggcagcccggcattgctcagcatattgggaaccgtagccagcacataggacatcgttgcgaaggttgtgacaccagccagaatttccgtacgtatactggtcttattctgtcctaactggaagcgacgttcacacagattgtaaaatcgggccattcccaagtgctcctttccgtttctcctgctgatagtctcatcatagcgcatttcggcaaattgtaaatattatgaaagttatttttgcttttttaaattaaactaaatggaagtcaatcctgcttttgccggtgcagagcagcctctcccgctgccgtaagccggtacaggttagccggacggcccttgttgccataaacataggtttgctgcagcagtttctgtccgcaaagaaaatccagatatttttttgcggataccctcgaaatatgcgcctcttccgaaatttcctgtacaccgaaccagccttctaccgctaaaatacagctgcagaccaagctcagtgtcgatttgtcaattcctttgggagatgtctcttcctcctcggccggctgatgggatgccagcaaatcgacctctttttgttccagaaaattcttttgaagaagctgcattttctgcaaatattttttcagcgcatcatttaaacgttcataagaaaagggtttgatgatgtaatccaggcatcccagcctaaatgcctcccttatttggaggctgtccttggccgctgaaataataatcacctccacctgccggttttccgccctgatctgcttaagaatatgcaaaccgctgctcccgggaaggtagatatccagcagaatcatctggatctgcgtctcacgcagcagcgcctgcgcctgctgttcattcgcggccactcccgcgatctcaaaaccggactgttctaaaaaatcagaattaatctgcgcaacctgcggatcatcttcaacaatcaatacccggtacatgtctttcctcctccctcatgcgggggatatgtacggtaaattcagttccatcccctgcctcgctgactattgtaatatatccgttataacgttcacaggcctgattcaccaaaaacaggccgatcccgtttccgtcctttttggtggtgactccatactccaggatattctcccgcagcttttccggaatctccggaccggagtcccagacagatatataaatttcctcggtggtctccacaatctccagcgccactgtcctcatggcgcatccctgcaaagcgtcaaaagcattttccagcaaattccccacaatcagaatcagatcctgcaaaagctcctccgtcagccgccctagcagttcggtacgatccgtaagtacaagatcgactctctgctcggaggccctgtcaaacttgctggccagaaatgccgccagcgtaggatccccgattttgccgctgatctgctgcagctccctgttcttcaaatgcacaacaccgtgaatataggtttccaattccgtgtaattttgagcctgaaccaggcctgaaaccacctgcagtttattattaaactcatgcatctgcgcccgcagtgcttcaacatagctttttactccggtaatattttcagcgaaccggactacttcctgcttggggcggaaggttaccagcaggctctcgtgctgcggctgtgagattttaatcggaataaaattaacataaaagctgtcggtccccagcctgcgttcattatcataaatcggctgattcccgttcaatatattctgcagtgaaaattgggggaacaatgtcacaaagccggcatcgccgtcatcaaatggctggcctgctttttcaaacatcagacgggcagtccggttcgcatgcgtaatttctccgttctgattcacagaaagaattccgtcacgtacagcgtcaatcagtatattcctctcaaccaaaagctgtgctatctccaccggttccaaattgaacatggttcccttgacattgtccgtcagatcccagacaaaaatcagtgcaatcagcattaccagcaccgtcatcgcgtttaaatccctctgtgccttttgcagctctctatgattggacgaatactgcagcgttgacagtatgcttccctgtaaggtgccgtctgacctgtaaatgggacaggcagcataaatcaggctgtcgctttttccctcagaaacgatatcatactgctttttcccctggagaagctcatctttatatttctttaacgccgtctcgtccggcttcagttccggagtgctgtagagaagccggaatttatcgtcgaaaatagcgacaccggaacaatttgtacattcctctgcctgccgggccaatgttctcagaactgccgtatctttgccgaaatctccgtcagccgccgaaagggaactcgataactgggttgtaatatccatcagagcagaggcaccggccttcatgaccgtttgcttcagactcatagataccggatactggttcagcagcaaaatcgctattacaactgaacataccagcaatgtgatttttgtgcgcagcttcatcattagtttatcatccttcaattgtttttctgtattttaccatgcctgttcataaaaagaaagtataagcacctgtacgcctgtgccgctgccgctgccgggattactgttcacacccaatgtcagttaagcaagatggagatttaacggaggttaggaggacgcgtccggaacggaccatgtccggtgtggtgagggggatggatgagtcttccatccctggttgaaggttgtcgtgaggggggaatccggtcggaatgaattcttacggggaccgtttgcactcttcgaagcgcatagccgtgctaaattcgaaaaaacctcattaagcacggatgggcttccatgtcccctccagaattgattccgcctccttcccccggtcaggttttcgccagggacggaagactcaggcggagattcgtgcaacaccgaacatggtccgttccgggcgctgattgtctctaaccttaaatggggagggccctgtcgcagccactatgtgtttccggcaggctgaaatcaaatcctccacaatttttataaaaggcgtattgaaggcatatcgtatttttcgtacacggtagcactgagtggcctcgacaaggtccgccccccgcacttaacgcgtgagactatcagcggccgcaggccggcggacggggccgatacccctggcggagtctttcgtcccagcgataacctggccttggggcggaggggaagataaagtctgcggatgccgcctaaatccatctctgattagcgaggtcctgttgagcttagcagcatgatgcatttcacagagcgggagcgtgctccgcagactttatcttcgcccgcagccccaaaccacgacaaacacacccgggacgaaagactcatatacacaccccaccaccccgtccgctggccgtaccggcggcgtcctcacctgcttaactaaatctccattttgattaactgacattggagtgtgaacagtaatctgccggacaaatagaataattttaagtaaaaagaatgttccaggccgctgacaccggcctggaacattcttttacatcttatatctttattttttcgattatctcttctctattccgcttcattgacaaacatgtcttccgctttatccggcattctattcctgtcccattcgatttttactttaaagagatctgcttcaattcccacctccatcgtgcccttctgtaattccacaaaacttctggctatcgcaagaccaaggccggagccttccgtattcctcgattcatctccccgcacgaaccggtccgtaatatccctgccttccagggaaatctccgtagcggagatgtttttcatggaaaccatgacagtctcaccgtcatccgtaatctccacataggcgcgtgtgccgggcagcgcatactttacgatatttaccagcaggttttcaaacacacggtacgtcttctcgctgtccagaatcaacaccgccttgtcatccggcatgttccagcggaattcaacctgtgagcgtcctatcttgtcctccagctccagcctcacctgcttcatcaggctgacaatatccacctcgacaagatggagtgtcacattattgctgttcgccttgctgatttcaaataaatcttcaatcaggcttttcaggcgcatggatttctgatccagaatcctgatatagttccggcgctcttcttccgttatcccctctttcttcagaaggttaacataagtaatgattgccgtaagaggcgtcttcagatcatgggagacattcgtaatcagttctgtcttcatgctctggctttttacctcttcttctacggcctttttgaatccgtttctgatttttgtaatctcgcccttcagcggttcaaatacgcccaaatcctcgttaatttcaacctccaggttgccgtcggccatctttcccgtagcctgcagcagtatctcatatttctcctgcatcccgtcatagattctcctgagcaggaaaaacaggactacagagtaaatcataagtccgaaaatcccaaagaaccagaagcagcttatcacggtcagcaggacaaaattaatgcctacgatttttaacagaagctttgtctgcttatccctgaaatctacagagccgaccagaccgcacgttttttctaccgcattcttgcctcccatcaggagccatccgataattgtacgttccttcagccaccgtgtcaggcccatcgtaaaaatggaatccagagatacgacaaaccagtatataaaggtaatgcctactgcccacataacagcgttgccggccatcaggatgccgtatgcctgctggtagctgaaattcagctcccgaaccagttcactggcaaacacgcctgtgacagtcccggccaccacctccattacaagatatccgccttccgacataaatgccagcgcacagccgccgattaatatcagaagctcaaacggcatcgcgaagaacttccgttccgtaattccaaggggcttaataagacccgtaataaatgcgacggcggccgtcaggaaagaaaatcccagcagcatccaggctactatctgttcaaacttccaaaaattatggaagagatattcatcgccgtttatcgtcatccagtaaccttcataaacgtcataattagaattagacgtaatcagttccgcattcataaatgcctgttccttaagccacgggtaggaggccatcacagccgccgtcatcgcgataattgtcaggagcaccagaacgactcccattctatggtaatttctcaattttgtatccaacgccccacaccacctttaaatattttggttttttcggatctaactctattttctcacggatatttcgtacatgtaccatgaccgtatccgtgtttattgcccgttcgttccatactctctcatagatatcgtcagccgagaacacatgacccgggttcttcatcaacagggagagtatcttaaattccatcggagtcagctttgccggttctccgtccaccataagctccacagtatcctcattaagttccagcccgccaatccggtaaatattgctgttctccccgccgtccttttcttccttcctgttcagcagagccataaaccggttatatctcctgagatgggagttcactctggccagcagctccatcggcgtaaacggctttgtaatataatcatcggctcccatattcagtcccatgattttgtccacttcctccgatttggccgacagaaagattaccggaaagtcataatgctccctgagcctgatgaccattgtcactccgtccatcctcggcatcatgatatcaacaattgccagatggatctcctccctctcaagtatctcaagtccttccactccgtcggccgcctgaaatacgcggtatccctgtccgcgcaggaaaatctcaattccttccctgatttccttgtcatcctcaaccagtaaaatccggctttctcctgctctgttctgtatttccatttcgtcctctccatattacatgcggcctaggcgcccatcactctgtccggcccctgcagaaccatccggccggaaggtcttaccaccgcgtaatttttcttttttctctttattatactacattttttcagttcctccgcagcaagtaagagaaaattaaggaaaatagtaaaaaccgtcacacatgcaataaaagataccgccgcctctgtaaaatattcagcactcattttgtcagttccccctttcagctccttttttaatatgatattagtatacatggcgattctaaagccgggtcgaaggaaaaaccaaagaatttctaaagatgaaacaaagatttcaggaaggaaggcttggcaggggaaaaggctggattgacttgtccgaatatgatagtatagagccagaaattacaactcacagattatgcaaaggaggtgccggagatggcagaccacagccattttgcctgcctggtttttgaccggaagcggtttgtcggggcaggcggcgtaagttttttcacagctcaccgccttcaacacaaaaaaacttcgggcattttctcccgaagtttttcttgtgtatctgtaatcacaggctttattaattcctgttggctttttccatgtggacattcttgcctttaattttgacatccttcatcgcctgtaatacgacgtcggcctgctctctcggcacttccacaaaggtatatttatcgaacatgtcaatgcttccgaccattctgcccggcattccggattcaccggcaatcgcacccagaatatctcccggtttgattccctggttcttaccgatattaatgaacagacgggcaacattctcgctgccgccgcggctgcctgatctggctccgcgtccgttgtttctgctccttgcgccccgctcgtaatcctccagttcatccagggaacgcagaggcgttctctcaaccgaaatatcttcgtagtcgtcacccatggacatcttgaggagggccgctgccagatcaagtgttgtatagtcttcctccagcactctcttctcaacgatgtttataattttatccagatcactatcgcggataatctcttccacgctgtccatgatcttctccaccttaatcgatgtcacgtcattcagggacggaatcggctgcggaatgattttagtcttgcagtaacgctggatttctctcagcttatatacttctctgccaactaccaggctgaaggccttaccttccctgcctgcacggccggtacgtccgattctgtggacatagtactcgtcgtcctgaggaatgtcataattaaatacggcttccacgtcgtctacgtcgatacctctggcagccacatccgtcgctatcagaatatcggttctgccgtttctgaagctgttcatgacacggtccctctgcatctgcttcagatcaccgtgaagtccttcggcaaaatagcctctgccctgaagctcctgcaccagatcatccacctgtctttttgtattgcagaaaacgatggagagcttcggatcatacatatccagcagacggcacataacctctacttttgtctttggctttacttcataataatactgtgtcaccttcggaaccgtcagttcctttttcactacctttacaatctccggatccttctggaatttcttcgcaatctctgcgatagcgggaggcattgtggcggagaacatcacagtctggcgttcttccggaagttcgctcaaaatggtttccatatcttccagaaatcccatgttaagcatctcatccgcctcgtcgagaactactgtgtgtacatgctccagcttcagcgtcttcctgcgcatatgatccataacacgtcccggcgttccgatgataacctgaatcccgtccttgagggaacgtatctgtcttccgatttcctgtcctccgtaaatcggaagaaccttaactccgtgcatatattttgcaaggcgcctgatttcctcggatacctggattgccagttctcttgtagggcacaggataatcgcctgtaactttttactcttcggatctaccttctgaagaagggggataccaaatgccgccgtcttgcctgttcctgtctgtgcctggccgatgatatccagaccttcaagctccagtgggatcgactggccctgaatcggtgatgccgcttcaaaacccatatctgtaactgcgcgtaaaatcttcgcatctaaatttaaatcttcgaacttaattgcttccattctttccctttcctgattacaacttcaaaaaagaagattcaagaaacgtctcagctcttgaatcttctcactttaactatatcttataaactatagcagatcttttgcaccttgtcaattgtggatttttatttgacaattgcccagaccgatattagaatcataagaagtattactgacggccaggacgaacgggacagaatccaagccgccgtttaccctgaaaggttctaaaccggttatcacactgcattgtataaaatatagcctgatttcacggaaggagaaatattatgaaaattattgactcacatctgcactattgccccggctctccctattttgatgagatcgcggtaagagcggagcatatcaatagtggagaacatctgcgggagcagtaccagatatacgaaatcgagacaggcgtcgtgatgggcaacaggggactttcctttgccgaacatgattatcccgattttctgcactattgcatcggaatcgacagccattacctgaaacatcacgacatatcagacgcccacgatatgatagaacagcatctgcagagagatgcctgcgcaggcatcaagctctatccgggctacagccccgtttatatcagcgacgccagatatgagccgatctatgagctggcaaaaacgtacagtaaaccggttgccgtccatatgggccagactgccggttccaacgcatttttgaaatacagccatcccctgaccctggatgaggtggccgtaacgcatcctgacgtccggttcatcatgtgccactttgggaacccctggctgatggatgccgccgccgttcttgaaaagaatgaaaatgtagctgcggatttatccggccttctggaaggcaagctcgtactggcggagcttttagaagaacagaaaggttatgtggacgctctgaaaacatggatagcctacgcgcactgctatgataaactgatgtttggaaccgactggcctcttgccaattacggggattatatcggattcacaaaagcagtcattccggaaaaacactgggataacgtgttctaccggaatgcaaagcggatctattctctgtaactgccgtcagattgttttgtgcaagcccgtttcctgtccgccccgggagccggccagccattgaatggtctgtccaaaccctgcgtacgcatacgggatcagcaggataaagtagcagattgtatactgcccctttccctcccatgccatgtgaaagagaaagcctccgataaaaatcaccgccgggatgagctgctcccatctcagcttcctgcccgcaaacaggagaaacagaaatgctcccatatagataaaggtctggaaccagttacatacgcccagatacagccggttcagcagccccccttcctttaggagggaatccgtcatgcccggaaggagccaggagcctcccttcacctcctgtatccacaggctctgaaaggttggctccgcccatatggactgggcctttctcaggaaaaaatctgccgcctcctcaggctgtgcggcaaactgagttatggtatccatcaaatcctcccggatcgcctctttcgtcttttccgtatcatcatcgtttccggcaaaaacactgacattataaccgttataccatcccggcccccggcttccttcctgaagccccatctcaacccaggcagtcatcgggattcccccagacaccggcctgccggtcgcctgctccagaaccatgttcatcagacgtccgctccccatataaaccagaatcatcagtacagccgccgccaggaacctggcctttctccggaataccccctccgataaaaggtagataaccaatgcaactaatacaatcagataattcgatttgagaagaacagaaactgcggctgtgacagctgcaataaaaaaacggctgagcttctctgtctcaatatatctgtatacaaaatacagtgctgctgaggaaagacagaatcccggcatagtaccgtagacaaacgtaatatagaaagcaaagggcaggcatgcgaatgtcagaattaaaatgccccggatgcttttcagaccaaacaaccggaccgccagacagctgagaaaatatactccgccgaataaaaatccgatattcagtatctggaccgcatacggagtaaggtccctgaaaatcattacgataaccgccagaaatagaatcaggccgttctgggacggatatgtataagcataccccagcggaaccatcggagaagaatagacaaagcccaccgcatcccagggagaataatcccccgacaggagggaacgggcagactccatcgccattctctgatcagaattcggccagtacatcgttatcagcagccaaatcaggtaaaatccggcaacagcgatgataagcctgcggtactgcctgaccgtcagactgaatctgtccgctccgattctccgtttccggtaaaaccacactccggctgccagaaaagcaatcagcaggaggatatggacaacgggctggtccgggccgtactgcaccttctcctctcctccgtacacgctgcacgtcacagtggcgcttatggctataagaaataaaagcaccgcgccgaacaggaactgaacaaagacagtgcagagacgttccagcacggtaaccggaccgccgcgcccggatatgccggccgcaatgtacggctgtgccttgtattctctgtctgctttccttccggtgatgcttttttccgtatatttgcttttataatccctgccgcctgaatctgtcttcatatccgtgcatcctcttatatgtcaaccttgttatgttactgttctcgtaattagagcaatcagtccgatattactttaatttttaataattgtcaacatactgcaccttaagagattcttacatgttaatcatccgttgttaattttattgagtatgggggacgcgtccggaacggaccgggccggtgtggtgagggagtatgtctgagtcttccgtccccggttgaaggttgtcgtgaggggggaatccggccggaatgaattgctgcggggaccgtttgcactctttggagtgcgcagcagtgctaagctcgaaaaaacctcgctaagcaccggcggactcccatgtcccctccgcaattgattccgcctacttcccccggtcaggttttcgccggggacggaagactcaggcggaggttttcgcaaaccggacccggttcgctccagacgctgattgtctccaccctcaatgggaaggggaaccttgccgatggacggggccgatacctctggcggagtctttcggcctggcgacaatctgcctttggggcaaaagactcacaaaaccgccccgtccgccggccgtaccggcagcgtcctcacctgcttaattaaatataattctctctatctcctccgcctccggcatcaccttcaatgcccctttcctggtcgtgataaccgaggccgccgcgtttgcgaaccggagcgcctccctgagccgggcttcattcaggctgtccaggccgtatttcaaaataaagtggaggatacagccgcagaaggtatcacccgcacctgtagtctcaatggtgtcttcccgaatgaatccggggacctccgcaatacagtcgccgtaataggccctgctcccgtctttgcccatggaaacacagataagtttaatatcataatctttcttaagtttttttaccccttcggtaaaatcgtcccttccggtaagccactgaatctcattatcagaaatcttcagtacatcacaatgggccagtccatagcaaatctgctcctttgcctcatctagcgatttccagagaggcggcctcaagtttggatcgaaggaacggaggacaccggctttctctgccgcccaaagcgcttttttcgtagctgtcctggccggttcatccgtcatggacagggagccgaagtgaaaaatttccgctcttccaatccgatccccgtccacttcctccggtgtcagcatcatatcggctccgggagatctgtagaaagagaaatccctgtccccgttatccagtttgtggaccagggcaagcgtggtcggcacttttccatcctccctgagtccgcaggtgccgattcccacatcctcgagcgcttctttaagctgcctcccaaacatatcccggccaacttttccgatgaactctgtctttcttcccagcccggcaagcattgccagcacattgcacggcgcacctccaggattggcctcaaacagaggattcccctgagatgtctctccgttctggataaaatcaatcagcagctcaccgagggcaattacatctatatcccgcatatgattctccccgtattgttgtaacggttcatgcagcatgaaccgttacgtatttttcccgttattccgttactctgatatcaaaaaattctgcgcatccatcctgcgccataaggccaatctgatactccgtatcaccatagtaccggtatgtgaacgcaatcttttcgcctgcgaaaatctcaatcatatcccgatcgattgcgactttgatatcgatcacatcgccgtccttatagggaaacggtttttcgcataccctgatgccgtccgggcccgcatccttcggaatgccgatattggtgcaggaagcttcccagaacggatccacctccatcggaagattgagaagctccgccctctgcattcctttatcaaaggcaaggacaatacactgtgtggcgtcgctgtccgatttcagcagcagcccgaaatgatccgccatgtccaccggctttaccttgcagctgaaaaggaagctcttctgtttcacttttataaagccatatgataatgtgctgacggaatccagataaatgcatttatccccataagtccggaattttccaagcttatgctcatagctccattccaccggctccagccacgcctccacatactcccggggcagcttcacatccagctcgccggactcattctggcagacctcatggggaatacagaactgaccgccccagtaccactcgccgaaattgctctgctgcgccctgtcatgagcccaggcgaaatagaatctgcgcccttcgtcattgaccagggattttgctgcgtaaaaacggcggccgcctattccatccatcttaggcgttctccacggcccgaacggagagtcggccacacggtaaatcgtattgacgaactcagagaagcgggaataggagagataccaaagtttacctattttatacatttcgcagcattccgggcagttggtatgatacggctggtaaatcggtccataatactcccagttgtccaaatcctttgagcggtacaatacaatgcatcctcttctggaaggcggcccttccttcttccttcccgatatcaggagccaccagcaattatcatcctcattgtaaaacacatacggatcgcgccagtctaccacctcatactctttctcattcggtatgataatcggatttttcgggtccttttcaaagtggatgccgtcatcgctgaccgcatggcagatcgtctgctggaagtgaacattgtaattgtagcccgtatagaaaatatggtattgtttttctccatacacagccgcgccggtccatacgccgcaggcatccggttcttcgccttcccccgggtaaagagcggttcccacttcctcccagtgaaccagatccctggaaatggaatgctcccatgtcgtcctgagtcttgcaggatacaccgtggttcccggaggcgatgtcagtgaaaaaatatgatagatgccgtcatgataaagcggaattgcatctcccgttgagtcagcccagcttaatttcctgaaaatatccatgtcttatgctctctccttcgcatttctgagtattctttttacaacactgtctttgcccttctgggtgtcgataataacggccaggacaataatcaaacctttcacaacaagctgccagaaggagctgagtccgatcaggttcaggccgttgctgataataccgattaccagggcgccgaatatggttcccgatacggctccgacgccgcctgtcatcgatataccgcccagaacgcaggctgcgatggcgtccagctcatagccctcgccgacccccggctggccggagtacattcttgcagagagaacaataccagcaaacgccgcaagaaatccggaaatagtgaacacggcaatttccactttcttaatcgggacgcccgagagtctggccgattctctgttgccgccgatggcaaatatgtatgtaccgaattttgtcttatttaagactacaatgaaaataataatcagtacaatcatgtacacaaccgggagcggcaggacgccgaacagctttcctgttccgattccggtaaacacatcgttggaaacgcggatagaacggccgccggagtaaatgtacgccacgccctttgccacgttcatcatggacatcgtcacgataaatgcaggcaccttgaaggtggcgatgataagtccgttgagaaatccggccagtgttccgagaagcagtcccacggcaattgccagaaccatgggcattccctggttgaccatcagaccggccgtcagagttccgcacatggcgacacaggttcccaccgaaagatcgattccccccagaataatgacgagcgtcattccgagagccagatacatattgtttgatacctgccggagtacggacaggaggttatccgttgtgaggaaaaccggtgaggcaaagctcaggatcacggagataataaccagtactgcaataattccagagttgcctttcagcattttcataaaactgttatttttcatattttacactcccgtagccaatttcataattctttcctgtgtcagttccagatgatcaatctcccctgttttgacgccttctttgattacacaaacgttatcgcacatattgataatctcaggcagctccgaggaaatcatgatgattgccattccctgtcttgccagttcattgatgattgaatatatttccgccttggcgcccacatccacgcctcttgtcggctcgtccagaatcagtatcttaggtttggtcgccagcgccttcgcaattacaaccttctgctggtttcctcccgacatgctgcccaccgggacatccggggaaagcgccttgatgttcaggctcttaatatactcctgcgtaacctcttctttctttgcatcgctcagaagcaggccctttgcgtaataccggaggcttgagagggtcgtattaaacacaatggaattaatcagggtcagacctgtcttctttctgtcctccgtcaccatggcaataccgctgttgatagcttccaggcagtttttgaaccggatttcctttccttccagcaggatacgccctgattcaaaccggtcggcgccgaatacgcatgtcataatctcgctgcggcctgcgcctacaagtccggcaaagccgagaatctccccttccctgactttaaagctgatattatcaaaaactccttttttcgtaaggttctccacttccagaaccacgcgatcttctttcagcgtatcgtagtcgcgtgtatagtaattctgaaggctgcgccccaccatcatcgcaaccagctcatctgtatccgtttccttcgtatttacagtgcctacgtaggcgccgtcccggattacggtgattctgtccgtcattcggaacagttcttccattctgtgcgaaatataaatgatgcttaccttctgctccttcagccttgtcattgtctcaaacagcttttccacctcttcatccgacagagatgaggttggttcgtccatcaccaggatttttacattgaaggaacttgcctttacaatctccaccatctgctgctgggcaatcgtgagttccaccacctttgtatcggcgtcaatatccagtcccagcttcttaagcatctcctgcgcctgtctcagcatttcccccatatttttgaatccgaaccgatccagaatctcacggcccaggaagatattttccgccacggtcagatgggggacaagcacaatctcctgatggatgattccgattccatgctctctggcaatctggacattatccatctccacatcttttccgccgatattgattgttcctctgtccggcctgtagattccgcccaaaaccttaattaaagttgattttcccgctccgttttctcccagcagagcatgaatttccccttccctcagctcaaaatggattccgtttaaagcatgaacaccgccgaagcttttttgtatatccgtcatctttaatacaatgttttccactctctcacctgcatttctgagttactgttcacacggttggattccgcgaggtatttcgtgtgcatttcacacgaaaatcccgggttacacggcgcggcgctatgaaaagtaaacttttcaccataatcaacggcgcttgccgtttctgtgcatcgcaaagcgtgttactctttacagcacgccgctttttggcatggtgtgaacagtactttctgaaaacaggcacttctgtttataagaagcgcctgccatgtctagagcgtgtttgataaatgctttccgtcagctggaaattttcaaacacgctctggtaactcttatgacgaccagctcttactgccagtctttcagcgttgcctctgccttctctttatctaccaggaaggaaggtaacagaatttctttctcgatttcaccgcctgctaaaagctcctctgctttttcaaatgcagtctcagcaattccgatcggaacctgagccgccactgccgtaaaggagccgtcgagaatagctgccttgccgtccggggatgcgtcgatggagtaaacgccgattcccgtcttgccggaagccttgatagctgccgccgcaccgagtgcagacgggtcattaatgcagaaaaatgcatttaaatcgggatttgcctggatgatgtcctccgcaatcggcatggagatatcgagagccgccgcgccgtcctgctgggccacaatgtcaaacttatcttttgcatcgccaagtccgtcaaggaaacctgccacacggtttacacaggattcattggaagggaaatccagtatcgcaattttggcaccgtccggatagtcggccgccatctgctgtcctatcaatgttcccgcattgtaagcgtctgttgcaataacggtttctaccaaatccagatcatcgtcgattaccggagtgtctacattaataatcggaatattcttctcatggatctgctccaggccctgtctgattcccgcagagtcaaccggaattacaaataccgcatcgaaattctggttggccacatcggccatctgggataactgggtattcaaatcgtaatccgggtcaaggcacacataaccgtatcccttttcatcacaaagctttttgaacgtatcattcattgcagcctggaatgtgttattctgtgtatttggaagaaaagcaaacttgtaagatgccgcttcggcaccttcctcttttgtctctgccgcctcggatgccgcgccttctgtctgtgtcttatccggagctgccgtacttcctgtacttccggaattggaattgctgcagcctgcgagggttgctgccagcatcgtgaatgccattacttttgcgattgtcttcttcattaatgatttcctcctcttttatctagcctgctttaaatactgttttgctgcttttccttgattccttgcagcaattcatgctgtctgaactgttacgattcctgctatattttcttttcttcatcaagcttgcgcgctgccttgtttacgtaaatattatcattgcaggctcacagagtcaacggtttttataattttctgcatttttaacaggatttttttgtggattttatgctattgtcctaattaaatatcaatatttacgtaaattgaggcgatatattaccaatttgctccatttttactttctaaattttataaaacctgaacagtaattctgctgttttacgtttagaatttgactttattttgagaaattgttatagtatagttaaatttacgtaaaagcaggagggtttatatggctatcaccatcaaagatgttgccagagaagccggcgtctcgatagcaaccgtctcacatgttataaatggcacgcgctacgttaagcccgaactcacggaaaaagtattgcaggccatccggaatacgaattatcaggtaaaagcggagaagaagcccggcactgccagattgggaaaaaaatccgttatagcggtcgtaatcccaaatgtcggaggctccctgtttaccaaaataatcacatgtatcacccagctgtgcgagtccaggggatactctgtttccatttacctgacctttgatgatgccgcatccgaaaaacggatactggaaaatctggtcggaagcaggcagaccgcaggaatcatcattgccccctgcggacttgacagtaagtattatcaaaagatccgacagaggaatatgcccctggtctgtatcgaacggaccgtgtcggaccactccatatcctgcgttgtggccgacagcaaaagcatcatttacaagggaacgcagaccttacttaacagcggccataagaaaatcggcattcttatgtcggacagggagatttcaacagtcaacgagcagcttaccggatttctggatgcaatgtatgatgcaggcgtacactgtgatgactctaatatcgtcaaaatgaatctttacaataacaaagactgtgaacgtgcgattatcagccactatgaagacttcgaacctacggcttatattgcctgcggcaaccggataacccttattctgatatcaacgctccaaaagctggcggtcgatattccgagccagctgtccgttatcggttttagtgatgagtcctggtgccatctgttcggaactcctctcaccaccttttcccatgactgccacaagatggcggaaaatgcgctgaggctgctttttaaccaaatcgacggaaaaaccgaggtagaggaggtacatatcccgtcgctgcttgaaatccgtaaatcggtcaagatgatcggcaaggggccttatggggagacgactgtttcacccgacaacctggatctgacccccgccgaagtaaaagaactgcaagaacataaataccgggttggcgtctcatttcattacggcaataccagttgggcggccatgcacgaaaaaggcctccgttatatcttatcgaggtgcggtgtcaacatcgtatccgtcaccgactcaaattttgatccgaatttacaggcaattcaactggagagcctgcggatgcagggtgttgatgctatcgtggcaatccctgtggatgacaccgcgacctccaacaaattccgccagctctccaaagagacaaaacttatctttatcagcaatgtcccggacggtatgagcaagggcgattattactctctcgtctccaccaatgaacgcgaaaacggccgcaacggagccgtactgcttggggaacattttaaaaaagaggataaagtcgtcgtcggatttatcgtacacggcagtaaattcctgggaacctacctaagggacatgattgcggaacagacaatccgcgaggagtatcccaatatcaccatcgtggaatcagaaccattttatcagattgaaaacgcatatgaggtggccaaaaaaatgatcctcgcccatcccgaaatcaaagggctttacgtttcctgggaaggccctgcacttggtgcaatccgggcgatgcgcgagctgaaccgctgcgatataaagattgtaacctttgatttggattatgagattgccgggattcttgccaacgaagatatcatccttgggctgagcgcccagaaagcttatgaccagggtgtcgcggcgggccaggccacagccaaagccctgctgaaccagaggggatatgaatatatcggcatatccccctgtatcgtggaacgccagaatcttctgtccgcctggagggaagtgatgcacgaaaatgcgccggatgaactcgcgaagatattgaaaaacgagttgtcgaaggaatagaaacgatacaaaaaccggatatcagctcattcatgagtttctatccggttttttcccgtacttgaataatcgtatttgtgtaaatatcctgattcgctttctgcccccagttaactgcagtaatactttattcggctatatactgctttatcttctcccatgtccttcatcccgcacacttcatcaagcgtcataaattgaaacacccccgattcataaggtttccactccggcagatgagacgcattaggacagcgacgctatagctgaacataccaactatggcagacaggatgcaattcaatatattaatcaattatcagagattcttcctaaaaaataatataccgtttagcagtgaactgtttcctcaattggaatcaatcgaaacagtcttttcagacttgaactatgtattacaggttttccggaacctgcctttccgttttatactgtaaaaaaatgaaatcccgtgtactggcatacacgggatttcgctttgtgtccacatagtcttaactactttcttagctatctttatactacactaaatttagtgttatcacaccttaaaccggtatcgcataagctatgtcatgtctaaccgcttttaacattttacaccctttttcaccttgttatctctaggaattttccacatcttaccttttctttcccttttatatttttctagccgtgtaactttcggtagtatatgcggtagtatgggagtccgatactaccaagaggaaaagacacaaaatcataccactctttagatgggaaaaggtgtttcctcaccctttcccgattattcgccatcataccacttccaaaatgaattggcaaaaatcactattttttttcctccgatacgctccgtccgaaatggtggattttccaaatatttatatataaggctttcactactatcagttatgagcattaaatcttgaggtgttaaaaacagcttacttctccattcattctgaacattgtaggtggcttctgattttgctcccacgtctaacctttctagtcgtttttttcgggaaggaagtacagtacatggaacacttagccatgaccaatgaccttcaacgcatttttatgcgcctacgtgttaagcgtactgactaacaaaatctatctctattctacccgtaaatgtgggtgttgtcaatgccgccgcaggcgttcattttagcattgacataaacaagagcgaccagaatagaaagaggtggaacggttttatctgttccgccttgactactttttttggtatttggcaaaatcattcttcgatacatcaaaatgaaaagaacaaccaccgttgtgcagtgcaataaataccaccccagtcacgccgaacgcaggctacttgtagccgtagtgagttattgctacaacttagcagatgcttctaacatacttagtaatgtaactcgttgtagcaatattaaggatatggagggataacactatgatatgtcaaatactaagggtcgcaacctataaagcgggagcgattaactacattggttgggaagaacaccgccaaaaatatactcataaaaacggcgatattgatgagagcagaagccatctcaatctaaacaacggaatgaaaaacaagtcgctatatcaagcatggaaaagccgtcttgaacaactagaaatcaaacttccagtaaagaagaatcaaaatgttatggagcagatggtgataactgccagtccagaatttttcaaagacctaggttgggataaaaatgccgctaaaaattggactaaccgagacattccaaccggaattaaaaaatattttaatgatagccttcgcttttgccatcgttatatcggaaaagaaaatataatttcagccacaattcattttgacgaaagcactccacatatgcacgttgattttattccaattattactggaaaacaaaagcgaaagagcgtctacgagaaagataaagacgggaaatgcgtccgtgatgcaaatggaaacgccataagggcaagggatagccacgggaagattatttatgattatgttgatgaaccaccatcaatcaatcgaactgaattttggtttgaacgtggcggacggcagtcataccgtaaacttcaagaccaattttataaggaagttgccagccactacggtttagagcgtggagaaatcggctccagcaaagagcataaagatcagagcaagcacaaagccaacattttaaataaagaaatcaaagcaaagcaagcggaaatatcgacattgaatacacttgaaaaacaatccgtgcagggtcttacaactgctttacaaaaaaatccaaatatacttgggcatataaatcaagccttaaaaattgccattggcaaagaacctccacaccaaaagatttcatacaccagagagcataaccgataacagcaaaggagattaaaaatgataatagatgatgataaattagaaatattagtgcaaaaagttctatcagatgaacgggagcgcatatacaatagttggttctgcgaaggagatatcgttactcccatattggaaatcaagcaatcacgttttcgtaaaaaatctactgtttacatggatttaggcgtatgggaaaatttccaatcggaaatcaaagaacttttacaagccttatattatgcacacaaacgattggaatattttgaagaggtacaaaatcaagaaattccaataacatttgacgaatacataaggaaaaatgtatttgattatgatacagcggcatttgaacgaatgagaaataaagtcgaagaattgtattacgtccaaacagatgatgaacgatagacacgaaaaatgcgcccaatactggacgcattttttagcaactatcctaccgcttcacaagctgatatgtatcgccaccgtataaatcttcaataatgagtgtattaccgctgaaactatatcgcatatatggactggcaaagacaccatttccggcataactcggcaaatagtctttcccaaggtcgcattctacccaaaatttattattaccttcatttgcaatgatacagattattccactacccgcataagttccggctacatctggaacttcggaactaatctgttcagtgaattgtgtttctgtagcctgcgcttctgcattttttgtctgcaccacaccatcaactgtccatgcaccattttcatctacggtatagccatctggtgttgtggtgcttgcatacataaaagaagttccatcaaagcaataacattcggatatcccgtcattatttccatcaatccataaccattcactcgtcgcaaaatttccagtgccagttttgtcatagcgccagtcattaccatcactcgtccactgtcctgccagtgctgtcatactcattgtaaataccatcattgctgtgaatactaccgttaaaaactttcttctcattgttctttctcctttttaaactataaaatgcaaatccccagccacgctttagtcattagggtgtttaagccagttttcgagttcttgatggctttctgcaagtatttttagcgtatcattttgggcaaatatcaaataaaagagggatgttatgataccgcataaacctataaatattgcaataataaggtccttcatgttaaataactcctttagatttatataatgtctttacaacattccatcgttattccgcaaaggtatttttcataaagcagtggaacgattggtgcacatatgacagccataacgcaaggtgcaaagtaaaaaataaagacaaggaatccaataattgtccctaatttcctaaaaggcaacactaacagttttccgacataaaaccacgcttcagcataagttagcagaattatattgacaactacgactaccatcgacaatgtttctagaagtttgttatctgcggtactgaatttcattaatagtacagataacactgtcaatataatcgccggaaaaaaacattgcttaatcttgtttaatctcctttcaacttttttctgacattctgttgcttgtgttgaacttcggaactcgtctactcctaacattttcgcactcctttaacttttttatacggaatttgtcacacaattccgccatgccaatattataccatttagaaaatatttgtcaattacaaataatcattactgataagtatatttatacttgtgtttgatatgcttgtcatgtggaggtgttcaactatgataattatcacaaacaaaagaattaacgaattacggatacgatgcggcatgtctcaaaccgaacttgcacagaagttgaatgttacccgttcaagtgtaaatgcttgggaaatgggtatttctgttccctctgtccaaaacctcttagaactttctcaaatatttcacgcatctgtagattacctaatcggcactgttcccaatgaatccgtgtgtctggataactacagtgaagaagaaaaagaacttatatatagccttttaaaatattttgattccaaacgttgacattagaaaaggctagatggaaatccccaactagcctttttcctgctgacggataaccgcctttactgattttatagttctgattgagcaacctaactcctccgccaatgatgcggcggtgaaatccatgtgggattttacatactcatatcgttgttgccttttttcttgtatgttagcacggttttccgcataacgctttgcatcataagacttgacactttttacccgcgccgcttgtttttgttcgactgtgtatgcggaaaatgaattttttatgtcatattcttgaaagtcaagaagggcggcaattcgagcatttgtatacatatattgggtcttagaagcatatgcgtttcttacaatctcctctgcttcatcgaaaaaatcgcgatctatatattgtttgacacgttcaacggcggcttcttccggcactaaaatcctctttaaaaaaatcgccgttatatgggtgtatattgctcgatgtcctttgggacacccttttcttctggcggcatagttatgcaaatctcgtaatatccgtttatatcttgattttgtaggcataggaaaagtgttaatcttcaattccggatgtactcccgttttagatgtggctgaatctggttgtatatctattttagatttatttatagcagaaaccgttttcgctgtggtctgtatgggtattggtgttgaccttttatctgctactttgatttttatagctttcgttttccatgtgccgtttttaatcatggtctgcttgcgcttttctgcccgtataagattacacgcctttatatatgcgtctatttctgattgagggtgtcgaaagcaatccagacgttttatatctatatctgttgacgggttcaaatggaacaaccgagtggttttgattgcttccatgtttttgacgttacggctcaatgggaaacgcaaaacccttgatttatttcggcaagctatatcggctcggaaatgggtaataagatagtctgtgtataatgcccgcaactttgaatcagcttcatttttcaagtccaatgtgtttacaatgtagtataggtgtagcccatgcccactcgaaaccagccagttcggaaacatagcagaggttagatggtaagtgcagtaaagatagtccttgatacctttttcgtccatctctgaaaaatcaacaccctccacatcatcaatatctatatagatgacattgatgcggctgacatttttgtctttacgccaacctttaaatatcgccggtgaatagtataaattcacatcataattgagtaaagctgtaaagcctttcaacgcttcatcaagtgttgaaaaagaaaaattatagctatagcctccagcggacgccatcgcccaaagaatgtcaccaccatgtaattcacaaaagacatctttaaaaaattcagctatgagcggatttggcttgacaccgtctgtcgtttttagcgcaataaacatatcaaacataaagtcaaatttctctgtcccttcaattagctgaggataattttctataaaatcaatatatagttctgaataaacacccatcatcttgtctccttttttaatatatattaaaagtatgaagcgatatcgcccaaatgtcaaagaattttactattgctacagttaataagatttatgataataagaatatgagagtatatcttattatagtcaatcggatttttttgcacccttttggcattggaaaagccgaagcatctcacttcggctttaaacattcttttattttaaaatatcaaaatccacagttaaactcttgttccaaaagtcaataatttcctgcctgtctccttgatcgtgccagtaagtcttggtacttgtattgtcctctatcacatgacctgcacagccataaacttgaaatgggttcacttgaccgctattcagcagaacacttataaagctgtgtctcaaatcatgcaatcggataacaggtaatggctcttgccctgccttttctaatcgtttattgattctcttctgtaattccttaaatcttcggcttacttttcccgggtgcggtaaatagtcagatacaatattggtctttgtcagatacacatattcaccacattcaagtgtctttccttgagaccattccaactgttgttccaatgccaactgcataaatttttcaagtacctcacaaatacaagttgtccgtgttttatccccttttggcagcttttctatgaatccggtgtttatctgcactctggctacgtccaccaaaatctttttgttttcaaaatcgaccttggaatgtctcaagccgcacaactctgaacgtctcattcctgccaaaaccggaagtccaaccatcaaaagggtacttctatcatcttccagtaaacattgatttaaaagtatatttatctgttccagcgtcaagggagtagcttcgtattttatgatatttccatagtccgcatctaaaaccacattttcgttaataccatactttgaaaaattctttttcataaacttccagaggtcaattaaatgacatttgtgcttctgtatggtattggtacacaaatccaaatcattttggcaatacaaaaagtaattctcaatttcagccgtgtccactcgctttaaatccatgttgccaaaataattgatgaagtgggtgtgttgggagtttttttgttgcttatatgaatcgctccaatgcttgtcgctatcataatacttctctttgtaatctttgattacattctcgatgtagacctttccagttgctcccgtaagtttcttgtgccttttagccgcattattctcgcctaaaattgcttttgcctcttttaacgtgtttactacctttgtagtctttttctgcttctccttgcgcttgcctgtctttgggtctgtaatgatttcccgccctaaatccagtgagacaatgtacttcccgtccttaatacgctgtttaatgcctgcaattcctgtctctcttacttcttctttcctcatcttctgacctttccctgtgttcctatcagcttctaccaatataacacagtccaaaatattttggtagtttttttggtagtatgatgaatgtttttcaaaagcaagagtgtgatttttccttataaacaaagggactatagggtatctctatttcattttataccttaaaccggtatccaactccccaaatcgtctcaatatactgcggtttcgccgtattaaactcaatcttctccctgatttttttaatatgcaccgtaaccgtagcgatatctcccagcgattccatatcccaaatcttgctgaaaagctcttcctttgtaaagacatggttcggattctgggcgaggaatgccagcaggtcaaactctttcgtagtaaaattcttctcttccccgttgatataaacgcgtcttgccgtcttatcgatcttcagtcccctgatttcaattatctcattctcgggtgttccgctgccaatcaggcgttcatatctggccatatgggcttttactctggcaaccatctcgctggggctgaagggcttcgtaatatagtcatccgcgcccaggcccaggcctcttatcttgtcaatgtcgtcctttttcgccgacaccataataatcggggtgtttttcacttcccgtacctttttgcagatctcaaagccgtctatgccgggaagcatcagatccagaatcagcagatcaaaatcttcttccaggccgcgctttaaccccgcttccccgttgttctccatctccacctcaaacccggaaagttccagataatccttttccagctctgcgatgctttcttcgtcttcaacaattaaaattctgctcattcctgaataacctcctggtattttctaagcacaaaatgaacttccgtgccaattccttctttactcgtagcccaaatcctgccgccatgatcttctataatctttttcacaatcgacaggccgatgccgcttccgcctttggaagaattcctcgaggaatccgtcctgtaaaaacggtcaaatataaacggcagatccttggccgcaatgccttttccgttatcctctatcacaatctggataaaatcaccgtcgtccttaatccgaatattaatgattccttttttcttgtccagatattttaaggaattaccgatgatattattaatcacacgcttcatctgctccgcatcggcaatgatcatgacatcattatcgacatagttgaaatatcccagctcgatacccctggtctccatgtcgagccccacatcctccagacagtcaccgaaatattctgccacattaatcttcgtatagttatatggtatcttattcgtatcaatcttggaatagaaggtaagctcgtcaatcaggcgatccatatcattcgctttattataaatcgttttaatgtatttatccagcttctccggcgatgaggccacaccgtcctgaattccctcgacatatcctttgattgccgtaatcggggttttcaaatcatgggaaatgttactgatcagctccttgctctctttatcatactggagcttctcctccgatgactccttcagtctcagccgcatctcctcgaaatcctggcagagcatgccaatctcatcttcattgtccacatccagggtaaagtccagattgccgtccctgatctgcttcgttgcctcctgcagcttattcagcggctgcagcagcgccctgtatacccacataatcaatattccggcggtaaaacagataatcagtacacccaccagcatcatctcactgatcatggtcttaatctcgggaacataatcaccgacattcgtcacgataaacaggctgccctgttccccgtcagtatacttgaaatcaatctgttttaaaaggtgctgctcctctccgtccatataaaaaccgccggacgcattggctttataatcatcatagggagagagctgttccgcaagctcatacccctcttccgacccggaaaagacaatctcgtctccccttctcagaatcagataggagtacttcttctccagctcactgtttaaagactccagatactccggattgtcaaagacagccggatcctcatccactgccttccggattgtattgtaaactccctgtgtcagacggttgaatacctgcatggaattgccggagagcagatcaatttgctcattcaggccgtagttcttctgaaaagaacggccctgataatttacaagtcccattacggcaatgtatatcagagcgataggaactacggtaattgtgataaatgcaattgcaagacgtgttttgatcttcatgtaatatcctcccgcagcactccctcacaggagtcagaaaaatatgagaaaacccgtggcatcggaataaagtgttaccacaaaaaaacttcggcggttttctcatatcttttcattttcttaatcataagtataccatattttgatagcttcgtttctaaaagtattataaaatattcatcctatttcctgcaaaatgccctgtttatggtacttttggcactgtcatacagaatcatccgcaaaaatccccggcttttgcggcagcaaaggacatcccccggaatattatctataccggacaacggtaacctgcacgctccgcgcacggttcaccgccatcagtaaaggacccggtctgacgaccgggccccctgttatggttcaattgtttcattgtttattatttattatttattcagttatttaaataacttctgagcagctccgccttatccagcttctcccacggaagatccagatcgttgcggccaaaatggccgtatgccgccgtctgtttatagattggacgacgcagatccagcattttgataattccggccgggcgaaggtcgaaatgcttgcggataattccgaccagctcctgatcgctcagtttccccgttccaaaggtatcaaccatgacggaggtgggctgtgcgacgccgatggcataggataactggatttcacattttgccgccagtccggctgcaactatattcttagctacatagcgggccgcatacgctgccgaacgatcaaccttggtgcagtccttgccggagaaggctccgccgccgtggcgggcatatccgccgtaagtatcaacgataattttgcggcctgtcagaccgctgtcgccatgaggtcctccgattacgaaccggcctgtcgggttgataaagaatcgggtctcggaatcaatcattccggagggcagaatcggatcaaacacatggcgtttaatatccttatgaatctgttcctgggaaacagcttcgtcatgctgtgtggacaggacgattgtatcaaggcggatcggcgtgcctttctcatcatactccaccgttacctgtgtcttgccgtccgggcgcagataaggaagtgttccattctttcgcacctcggtaagacggcgggccagcatatgcgccatataaatcgggtaaggcatgtattcttccgtctcatttgtcgcatatccgaacatcataccctgatcgcctgctccgattgcctccagttcttcatcagacatcttgttttctttggcctccagagccttgtccactcccatggcaatatcagtagactgctcgtcgatggctgtaattacaccgcaggtgtcacagtcaaaaccgtatttagccctgtcatatccaatctcacgcactgtttcacgcacaattttctgaatatccacatacgcatgtgtagtgatctcacccataaccataacaaggcctgtcgttgttgctgtctcgcaggcaacgcggctcatcggatcctgtgcaagcaaagcatccaggatagcatcggaaatctgatcgcacattttatccggatgtccctcggtaactgactcagatgtaaaaagtagtttttccattattgtcctcctttaaattgttgatggcagccgcactgagcgcgccggccattttggggtaaaagaaaagtccgtagcaatacggacttgatcatagcctatcaaatcctcttattgctcgattaaccgaattcttccggctcctcgctcaggctggcaccttccgttccctgccgtccggacttatcgtccttcctgcttaaacggggttgccgtgacttcacagatcctttgtatctccatcactctgaataagggatattacgtacttttcaattttaattaactgcaacatgtacgatatcatactctctttattatgtcaagtgatatccagaaatatatggagatttagttaagcaggtgaggacgccgccggtacggccagcggacggggtggtggggtggtattatgagtctttcgtcccggggaagattgtcgtggtttggggctgcgggcgaagataaagtctgcggagcacactcccgctctgtgaaatgcatcgcgctgctaagctcggcaggacctcgctaatcagcgatagatttaggcggcatccgcagactttatcttcccctccgccccaaggccaggttttcgccaggacgaaagactctgctgagtgtatcggccccgtccgctggcctgcggccgctgaatgtctcacgcgttaagtgcggggcggaccttgtcgcggccactaagagcttccgtgaacgggaaatacgatatgctttcaatgcacctttattaaggaattgtggaagatttgatatcggcctgccggaaacacgtagtggtcgcgacagggccctctccatttaaggttggagacaatcagcgcccggaacggaccatgtccggtgtcaaaaacctccgcctgagtgttccggccccgacgaaaaactgaccagggaaagtaggcggaatcaattgcggaggggacatgggagtccgccggtgcttagcgaggtccctcacgagcttagcactgctgcgcactccaaagagtgcaaacggtccccgcagcaattcattccggccggattcccccttcacgacaacctacccacggggacggaagactcagacagactcccccactacaccggacatggtccgttccggacgcgtcctcccaacctcagttaaatctccaagtactaaaaattcgggacagagcatcaaattccggtcccacaccgaaattcaatactctgtcccgaataccgtatcaggctatcagcctgtcaacctacctttaatttaaacttctgggcttccttttcagaatccactttctcaatcattgcgcccagacctttaagttttttctcgaaattctcatatcccctctggatatacccgatctcatctactatcgtatatccgtcggccgccagtccggctatcacaagagcggctcccgccctcaaatcaggtgcgttgacctgagcgcccgtcagtttcctgactccgctgataattgcggaaaatccttccactttgacactgccgcccatcctggtaagctcgtccacgtatttaaaacgattctcaaaaatgctctcggtcacaatgctggttccctctgccagggccagtgtaacagtcatctgaggctgcatatccgtagggaaccccggatacggcagagtcttgatgtctgtatgcctttgtttgggcctgcccacaacacgaactgcctcgtcaaactccataacctcgcagcccagctcaatcagctttgcactgattgcctcaagatgcttcgggataacgttctgtaccataatgtcaccgcgggtgattgctgcggcgcacataaacgttccggcctcaatctgatccggaataatcgaatattctgttccatgtaatttatggactcccttgatacggatcacatccgttccggcgcccttgatatttgcccccatactgttcaggaagtttgcaacgtcaaccacgtggggttcctttgccgggttctcgataattgtctccccctcggccagagtagccgccatcataatattgatagtcgctcctactgaaaccacatccaggtagatatggctgcccaccagatcaatggcatgggctacaacagcgcccttctccacttcaattttggctccaagggcacgaaatcccttaaggtgctgatcaatcggcctgctgccgatattacatccgcctggaagcggtacttcggcactcttatatttgccgagcaaagctccgatgaaataataagacgcgcgaatcttgcgtatatattcgtcatcaacgctgacttctttaatgtttcttgcattgatacggaccgtatgacgagcaagcctgtctacatcggcgccgatttcctctattgcttctaaaagtacattgatatctcttacatccggaagattctcaattaagacatcctcgtcagtcatgattgatgcagccaagatccccaaggcagcattcttagcgccgctgataatgacttctcctaccagcggattgccgcctttcataatatattgttccatcctcgcacctcaaaatatatattaaaaaacaatgtatattgttacagaattcttaaattctaacaaccgctttctactgattataccatatcgtcaggatttgtaaaggtttcgtcgttttttttactctgcgggcaggaaaccgatgaaatcatttccgccgttatccgtaaaaaatgccgccgcatcatttaatcccatcttgtcaaaatatgcatattccgtccccgggaaccagaaacatgatatattatactgatcatagccatatatcaaaccatagccgccgttacccagatatgccaccaccggacggccgcggtatacaaaatacagaatctgattcagagtacagcctctcgcatcaacaagcctggttccatccgtggagacttcattcccctgtgccagttcatccagataacgctcgaccacagccacttcattctggatatctttgatggtcttcacgtcacttcggtttgcccgaacccagaatacgtatccattctggtcggtgacaaggcccatatcatcataagccgctttcaccgcctgagcaaaatccacataggatccgttcatcctcccgccgctgtatgcataataacgtctgatgctgatcggatggttggccgtcagggatatcacattattttcctcggcaaccgcctttttaggcacatggacccggatggtacgtgattttgccgcctgcgaattcagttggacaaaatacaaacgccctttgaccgaatctgcaagatatccgattcctgccagcggatccgcaatcacttcttcattacagaccagggtgtcttcatccaccatctcatagtcgcctcccgctttacgcattcttgtcatatgcacgcggctgtcccgtatctgcacatcggtcagataaagtccctgtctctcatagcgcgtctccgtctccatcgtgctgcccacaatctcaagggcgtagagaggcaaaccggtaatgcggccgtctgtcatcagcttttcaccgggattcgccagaccgtagacgagatcgcttcccacaaatcccacaagtcttatcaccgtctgatcctggaaacggatttcatcctttttacctgttttcaaatccatgacattcagtttttcagagctgtaaatatcacttccatcctgccatgcgattcgggaaccatccgcactgacagcaaaattttcttccgtcagcccgtcggccacaaccatatattcttttccggacagctccaccccataaactgcatgatccatcagaagataaagggtctgattgctgctcaggtagctcagccgtccgatatcctggcgcaggctccagtaatcttcgccggaaggcagataaagccgctctgtgagtgtattatccccattctcataccggtaaagcgcaacgcccgtcgttccctcatgatttcccctgttcatatatccatatacaaggaaatcgatattgccctcctcacttaccgaaaggatcttgacgccgtgtgaattgaaattagtgcgcaaatcatcttcgctcttgcggaatgcaaagaccttcgtactgcttcctttatctgcatcatagcaccagagggcgcggttagccacgaacgcatggtatttctccgacgaatcgctcatagtctgcagttcctccgagtcggatattccgagcataatccgcttgtccgaataaagattgctttctccggagaaaatctggtttacgcgcctgtcataattcatcatataaattctctgagtgttccacttcatcgtgaagctctccgtcacatcataaaactccctgctgccgtcctcatccgttgtgctggttacgtaatcaagctcgataatgcccattactccctgcatttctctcagatggacagacacctcgctctctctcttcatttcaagaccgcgccaggtcagctgcgtaaagctgtttttaagagtcactttccccagtgaactgttatccgcgttgggatctgtctccagataagtggtcaaatcccgcgcagtatcatagctgaaggtcttatctgaaaattccatggccaggttcagcatatcctccatgtggtggttttccgaccacatgatgcgggtgtaatagtatacggcaggatgctcctctgtcgagattgccagagtcatcatatattctttccccgccgacagaaggttctgaatcggaagcactgcctttacctgtgttccctcctgcgtccattcctccagtaccgtcctttccacaaggcgttcgccgtccaggcttcttatttcgtactggattcctttcacttttgagtctacgtcttcaaagctaacaggcagtctgcgatcctccggcagcacagtcagatctccgcggcctgcacttgtatgcctgtcctcgacaaaaccgtagagacagttcattttcctgccaaacagctccatataaacgaccggcagattggcatcctcgatcgatgtatacactgcgccctcgtcatcttttccggatgaccatatgaaatagacggccagagccgctatgaatattaccagtaaaataactgctttttttatcgtttttctcatattgtgtgttccttctatattaaaatgtttcccgatacaggtttcaagtttattaagttctcatagtatatcatattcccctgccaaattccagaaatagatgaaatagcgtagccgtttagtaacagttcagccatgatgtgtcccgcgaggtgtttttgccgtttttgcgaaaatcccgagttatgcggcgcgaaacgtcgttttttaccgtttctgtgcatcattttgtcgcagcttggccggagactgaactgtaagatcgtttacgctgtctgaactgttacggaacagcgaagcttcttaagtaataaagcgtctgcttcttaaaatactctgtccaaatgtatcatgaaataatccaaaaaagcaggaaaaccaaataagtcttcctgctttcccgtatttctgaataatcagctggtttttctatcttatttgccgccggtattttatctgcatcttccggaacggcagcgcctgccctgcagttcattgaataaaaggattcccaggatatcattcataaaattattcctgggccggggcggcggaccccatggacgaggtggtgggcagcatggagtaggtggaggtggtggcggaccccatggcctgggaggcggtggcggcgggccccacggattaggcggtggcggcgggccccatggattaggcggtggcggcggaccccatggattaggcggtggcggcggaccccatgggcgcctcggacctgcctcttgaatctgggtagtctcatccatctcccatgtccggtatccttcccctcctccgtactcattgcgcacaggaccataggaaactctcggaagcgtttcctggatttcttcaggctccacttcttccgttgtcatctcggcctgttccggtttctcatcggaaacctccgctctctgtgcgatcttttggatcatctgctccattaaaatgcggtccggatactcgtcataaatcgggctcccttcgtattccatctcatcgcagacttcttccacaactaattgcaaagctttaactctgtcgggatacatactcttaaagtactcaaaatcccggattcttacatttcgctccgcctggacagcctgatccttgcgatacagtatgtagggctctaatgctgcttcctgcgttcttaatctttcatacgaaaaatcctgcatctgattcccattcctccttctggcatgaagttatatggtatcatatgcaggatttctccaaagtttcttgatttactgtccccaatccggaaatttattgaaaaagcttttccggataaactccctggctgattaaagcgcggatagactccgccacgccttctttatcttctttatatgttacgccgaaccagtggtctctcgtctcaagcaccttgactctggcgcgcccgtccttaatcatctgatcaataatcgtcggaagcagatattctgatttcaaatccccttccttaagaccgcttaaaaattccgggaaaccacgctccagctctttgataaacgccggcgtcaatccccacatattcatcgatacgtgctggtcttcccttacagtaacaggatttccttctttatcggaagccgtcaggccgtcagccgttttgataatattataggtttcccttaccgccctgagaatctcgtcttcccctacttcacacacgcctctggtaacgcccccgttgtcactcagcgtattcgccagtatgaatcctcccatgcatatgtcataaaccggtgcattctcatccatatcgccagtcatataatcatggatctttttaaatacttccttgccgtaatagtcatcggcattgataaccaggaacggctcgtttacgatgtcacggacactaagcaccgcctgccctgtcccccacggttttttcctgtcctgcggtaccgtaaatccggaaggaatatcatccagttcctgaaatgcataggaaaccggtgcaatcttctcgattctgtctcctatcacttccctgaaatccttttccaaatcatggcggattacgaacacgatcctgtcaaatcctgcttcaagcgcatcatggatggaataatccataataatttcaccgcccggtcctaccggctcaagctgtttaattccgcccccgaaacgactccctattccggctgccatgatcacaagcgctgtttttttcatagttcttctcctcattagctatgtatctgtcccgatactgttttctcaggtaataactgtaatagagtataccacaaccggatcagttctgcaattcggatttgattaagcaggtgaggacgccgccggtacggccagcggatggggtggtgggattgttttatgagtctttcgtcccgggggaagattgttgtgagttggggctgcgggcgaagataaagtctgcggagcacgctcccgctctgtgaaatgcatcgcgctgctaagctcggcaggacctcgctaatcagcgatggatttaggcggcatccgcagactttatcttcccctccgccccaaggccaggttttcgccgggacgaaagactcaaggccaagggtatcgcccgtccgccggcctgcggccgctgaatgtctcacgcgttaagtgcggggggcggaccttgtcgcggccactcagtgcttccgtatgcgggaaatacgatatgccttcaatgcgcctttattaaggaattgcggaatgtttgatatcagtttgccggaaacacgtagtggctgcgacagggccctcctcaattcattccggccggattccccctcacggccaccttcaaccggggacggaagactcagacatccccctcaccacaccggacatggcccgttccggacgcgtcctccattctcaatcaaatcttatttcaaaaagttcacaaaccccgtaataacaaaagtattaaccagattgataaacaggctgcctacaagcggcacaataaagaacgcatccggggattgaccgtattttgcctccacagactgcatatttgccattgccgtcggaactgcaccaagcccgaaaccgcagtggccgactgcaatcatagcagcatcatacgtctttcccatgaatttaaatgtaataaacaccgcgcagacaaacatcagcaaggtctgggccagaaggagcaaaagcatggggactgccagatccgcaagctgccacagcttcagtgtcatcatggaaagagccaggaagattaggagcgagatattgcttataatggaaatctccggaagtctcagcttcaggcggtccgtattgtctgcaatgtttcttataatggcggcagccgtcatccccccaaccgatgcaggaaaagacaggcctgtttttgccagtaaatccgagacaagacatccaagtgaaacagcaatcagaagctggtatgcccctacggtcaatgcccgctcacttgagccgcccgacgcttttcccagctctttatcgtccagcttcacggagacagccgccgcatcggaactctttaaatggtaatgctcgatcaggaaacgtccggtcggcccgccgatcaggctgcctgcaaccaggccgaatgtagcggcggccagcgaaattgtgttggcatttgcaagtcctgcctcctctaaaacgggagcgaatgctgccgacgttccgtggcctcctgtcatgggaattgagcctgtggcaaggcctatgagcggatcaatccccatcagctttgatagccccactccaagcaggttctggaatacaaccacgacagaggaaataatcaggaatataattacttgcggccctcccttcttcagcagcttccagcttgctgtaaaaccaattccggaataaaacagcagcatgaagaagtctttgaaagccatatcaaattttatctcgaaagctcccgtttcatgcccgataaggattataaccgtacataacaggccgccgactacaggtaccggtatacagtatttttgaagaaccataacccggttgcggattgcctcgccggcaatcagaataacgatcgctattgctattgtatgatatacatttaattcaattgtcatagttattacctccctgccttctccttctgaaaattataccaatgctttccccgcttccatcaaagtctttccgtccgccacaatcgtcgcatctttcataataagatcatagtggcaggatgccttcacaacgccccccagcgtgatgcttgttccgattccgatatgggccgaaccatacacgccttcatcttccagcataaatcccataaaacggcactgaggattcagccccacgcccatctcagctatattatagacatttgggtcctgtttagccgccaaatctgcttttagcatttcagcctgctttcccccctctatcgaagttatgaaaccgttctccacagtaaggcgtaccggttcatccagaacaccgattccgatatagggaatgctggcatccgccactatcactccattagccgttccctccaccggcgacacattggcctcgacggtgggaatcgtggaaaattcacctttttcaaccatgcagtagagggaatttcctcttctgccggctgccgaatatctgaggtttgtcccggctgccgtcgtcagtacaatttcaccggaaccggccagagcggctgccatcgccttgcataccacttttgcctcctcaaaattgcactcgatgccgccgtgaatcatcatatcttcactgaactgggtcagaacaacgcctctggaaccgttctgtgtcgcctccttgacggcgttcgtatgggtaatggattttccgacaatggaaatgaaagcgtcgctggttttcatggcagccgctatggttcttggaggttcctggctgtcctgttctcttggttccataattgtgagaataggatgcgcccctacccggtatacggctgccgccacggcctctgcgattctcattttagattcttccgtgataatgacaacctcttctcccggctgcaccttgacacaggtgctgaccactttgtctgcacctcttgacattaaaatcttcttcattttgattcctccttatattgtttttattctattttctatattctatagaatttatatgggtaaaaaaaagaagtttccttcttttttatggtgtatctggactaggtgtttcttcgttccgggacgaccggcagctctctatgtatttctggccgttgcggatatgcgtcaccatagcctgctgcgcctgctcaagccggtgatcccttatagcttgcgctattgcaacatgctcatggtaaatctcattcctccgcttttcatcactggcagaatatttcatatcccgggcaataaccgtattcaacatgtcgagcagtctgcaaagcatcgtattgtcggcagtaagataaattacgtcatggaaacttttattgattctggaaacttccataatcccctcagtttctttttccttctcgataatgtcgaagagctgcttcagggcattgtcgtcaaaacgatcgatggcctcttcaagagccatcttctcgagcgctatcctgcattgataggcctcccttatctcctcctcgtcgagttccttcacaattgccccgcaataaggtacaatctcaataaaaccatctcccgccagcttcttgaaagcctctctgaccggagtggcgcttacctccatctgtttggccacatgtttctcctgaagtttcgttcctggaggaagttcaccatccacaatcgactgaacaagtattctgtataccttttcactcaaaggcattttccccactgttggtaattcgttaatcagcattatttctcccatccgcgggaagaccttctatattctatagaatatagcatcttcttctccgtgtcaatacttttgtattattttattataatgaagtttgactctaaaagcaatattccgtcactttttcttgttgtaccatgataaaactgatataataattttatcatgaaagtttggaggggtaacatatgaaaggtaatgtaattgtcggccagtcaggcggaccaaccgcagccattaactccagtcttgccggtgtataccggactgccatcgacagaggggcgccaaaagtatatgggatgctgcacggcattgaaggcttgttaaatgaacaatatattgatttgtcggagcatattgagaccgatttggacgtagaactgttaaagaggaccccggccgcctatctcggctcctgccgctataaactgccggagattcatgaaaacatcgagtcctacgaaaaaatattcgaaattcttgataaacttaatatagagtgttttatttacataggcggcaatgattctatggatacaatcaaaaagctttccgactatgcgattatcaaaggatatccgactaagttcgtaggagtcccgaaaacgattgataatgatctcgccctcaccgatcacacgccgggatacggcagcgccgccaaatatatcggcacatccaccaaggaaatcatccaggacagcagcgctctcgtttacagcaaaggtcttgttaccattgttgagattatgggacgtaatgcgggttggctgaccggtgcggccgctctgtcggccggggaggactgtgaaggcccggaccttatctatctgcctgaggttgcctttgacatcgaggatttcctctcacgcgtaaagaaactgctcgagaagaaaccgttcgtaattgccgctgtttccgaggggatccgtctggaagacggtcggtatgtctgcgaattaaccgacggagtggatttcgtagatgctttcggccacaagcagctgacgggaaccgccaactatctggcgcgccgtctttcccaggaaatcggctgcaaaacacgaagtatcgagctaagctccctccagagggccgcttcccatctggcatccagaatcgatatcctggaagccttccaggtcggaggcgccgccgtcaaggccgctgacgagggcgataccggggagatggttatcctgaagcggatttccgatgatccgtatcagtgtacaacggagctgcgtaatgtacacaaggtttccaatgtcgaaaaaaccgttcccagagaatggattaacaagaacggcacttatgtgaccgaagagtttatcagctatgtccgcccattaatccagggagacgtttcccctgtaatggtagacggaataccgagatatctgtatcacaagaaaaaatagagtaacggtacatgctgtctgaactgttacaaaatagtattgttaccggagctatgcagtaatcagggatttgcagattaccgcttctccgggtaggcacaggagcctgttcatgcggcccctgtgtctttgactttttaaattcagaggtgtttgtatgacgtcaaccgatgttaatgtatatttaaaaaatctgtcattctggaatcacatctccgatgatgataaaagactgataatcgacaaactgcatttgctgcattacgaagcgggccagtccgtacactcaggcgaggatgagtgtctgggcgccctgattatccgccgtggcatactgcgtacattcctgctgtccgacgacggaaaagaaaccaccatgttcagactcagggaaggcagcatctgtattctgtcagcatcctgcatcctttccgccatcacctttgatgttcaaattgaggcggaaacggactgcgatgtgctgctgattcccagcgccgtattccagtcgctgatgaagaacaatatatatgttgagaattttgcctaccggctgatgacagagcgcttctccgatgtcatctctgccgtggagcgcatgttttttatgaatctccggcagaggatcgcggtcttcctgattgacgaatccgtggcccagcgttcctcaacgctggctcttacccaggaacagcttgccaaagccataggaagcgccagagaggcggtgagccgcaacctcaagcttctcgtcaaagacgggtgcatcgaaatttccagaggtacaatcaatatcctggataagaaaatgctttacgagattatctcaaccgaggggtagttttcaccaaaagaccggacaggggaaaaggcggcagaaagaaaagagacaggaactgccgccgcagtattctcctgtctctttcttcattctattacacacattccgctttctgcaattcccgtatcctacttctgcaatgccttttccagagtctgataggactgtacgccaaccatctggtcctctaccttgccgtttttaaagacaatcagcgtcggtatggacattacccggtactgctccgcaagttcaggctgttcatcgatgttgaccttcgccacgctgtagccgccttccgccagtttttccactaccggtccctgcattctgcacggaccgcaccagggagcccagaaatcaacgaggacactgcctccttctgcatttaatacttctttatcaaaattctgttttgtgagttcttttacgttagccatgattcatcatttcctttcacttaaatattaaaccgttatgttagcttattgtggacttattactacgatgattgtattataaatataaaaatgccgctgttctgtgactaagtcacaaaccataagcaggattaaattttatttacggaggtaccgataatgaataacttgcaaccgtcctttcgtttcgcgcagagaaaggatacgggactgattctggcctttatcaaagcgctggccgaatatgaaaaaatggccggcaacgtcattgcgaccgaggaactgctggaagaatggatttttgacaagggaaaggccgaagtgctgtttgtcgtggagaacggcattcccgtcggtttcgcccttttcttccataacttctctaccttcctcggaagagccggaatttatctcgaggatctctttattctcccggaacatcggggaaaaggctatggaaaagcaattctgaaaaaactggcggccacagccgtggaacggggctgcggccgtctggaatggagctgcctggactggaaccggccaagcattgatttctacctttccctgggtgcggagccgatggaagattggacaacctaccggttcagcggaaattcccttaaaaaaatggcagaaactgatagttaacggtaaacggccaagcattgattcagcgcatccggcctgttacccgcggaacatattttccacgtaattcttcatttcctgtctgctctccacctctctggaaccgtcgatataacgctcctgctcttcatgagacagggccgcaaaacggttcagtatatctgaatgctgcgccagttccatggtgaagccgattggaagttcatgattatcgatcatattcatcacctcatcattagaatgcgcggattttataattatatgtaaaattattttaaatgaatcaaaaatctccccaggagaccgtacaggaccggtcctcggggagattttccgattttataagaaattaattcgccgctgctttcttagcctgcattttccggattaccggtaccagggcaaaaacaagaattacaacaacaataacgatagcgataggcctggagaagaagtacggtaccagaccgcccttcgtcgccgcgattatcagggtccgtctgaagtttgactccagaatatcagccagtacaacacccagtacgagaggcgccggctcaaagccgtaaatcttcatcagatagccgagaagtccgaatacgagcataattaccacctcgtacatgctgttgctcagggcatatgtaccgatgctggcaagagccacgataatcggaaccagcacggagtttggcaccagacagattcgggccatatgttttgccatagatactccgatgatacccatcaaaatatttgcaaacaggtaacccaggaaaatggcataggttgtcggagctttggagccgataaataagtcactgcccggctgaaggccgtgcatcagcagcgcgccgtaaagaatcgcggtaacggggctgcccggaatacccagtgtgaacagcggaatcatggcgccgccgcaggccgcgttatttgccgactcggaagctgcaattccgacgatagagcctttgccgtattcttccggattcttagaggtacgttttgccatactgtagctgatccaggctgcgattgatgcaccggccgccgggataaagccgacaaaggaaccgataaccgagcttctaagcattgtcggcgccagcttctttccgttacccttgctccagcgttttcccttcagaccggcgctgggatcctccacaatcgtggaacccgtaccgcgcatcagcttctccaccagaatcagtacctgggagatggaaaacaggccaatcagaatcggagtcgaatcaagtccgtcctccagccagagctgtccaaaagtaaaccttgaaacaccgctgatggagtccattccaatacagccaatcagcaatccaaacagagcggcaaaaatacctttcgcctgattttcaccggtaaggccggctactacaagcacgccgaagcaggctaccaggaagtattccagtgtggagaacatcaggctgatctttccgagtgcaggagcaaacagaatcagacatatgcctccaatgattccgcccacaacggacgctaccgtaacaacggaaatcgcttccatgccgcgcccctgtttggtcatctcataaccatccattgtagtggcggcagaagctgccgtaccaggagtgtgacagagaacagcggtgattgaaccgccgtaaacgcctgtggtgtacatggctgtcatcataaccagagctgctgtcgggctcatggaaaaggagatcgggagcagaagggcaataccaacggacggcccgagacccgggataattccgataaccataccgcctacaacgccgacaattaatgcgattatgacttcaattgacatgaatgaggtcagcgcgatcgataaatattctaacatttaatctccctcctcttacagatagcggaaaaaccggcccaaaatacctattttatagataggaaggtgcagaataactacaaacacgataaacgcgagaattgtataaagcacggtaatcagcaggttaatcttgaatgacttcagtttcagatacttttgtgtaaaaagcataaatatcggggttgcaatccaatatgtaatatatcgaaatccaagataatagataaagataaaaaacataaacaggaatgcatatttactatttttaacagtcagcggataactgtactcccccatctgttcttttgtcaggcgaagcccttttaatataatgaaaactgcgcagacagccatgaggacggtcagtgcaaccggcagataagcggcctgccccgaaatctgcaccgcattaacaagcacggcggcgcaaaacaacagcagaaccaggcccacccacacatctctgtgaaatttcttactcatatcgacagactccctttcttttgtcaggtcatttagtgttgctgcctgccgccccgctcacatacgagggggacggcaggcagagttaattcactattattcagcagagccccagatctccttacgggtatctacctgactctcaagcagttctttgaatgcttcaccggaggtgttgtcaagcttcagtcccagtgccgccatattgtcgacatactcctgatcctccatcacctttaacatggcctctgtcattttagctgcaatctcaggtgacacattcgtcggatagaagtaaccgcgtgctgcgaatgccacgaaatcctcgcctgttgcctcttttacagtaggtacgtccggcataaaatcactgcgttcttcggagaagacacaggcaattttcatctcaccggactgatatgcgctctgtacatcggaaatggaagcaaagaatacgtccgtatcgcctgccaggaacataccgcggctgtcggaagcgccgtctaccggtactaccgtaatctgagttccgaaggtcttattaaaccactctgccgtagttgcatcgccgtcggtaataccggtcgcctgggcagaaacaagaaccggatttgcttttgcatactcgataaagctgtccaagtcggtaaaacgtgtgtcattgctgcggatcgccattacattgtagtcgattgcctggttagccagaagctgcacgtcgtccagattgtactggcgtgggttgtccggatccagttctcccatggcatagttatgattaataagtcctaccgtatatccgtcgtcatagtcgccggtaattaaatcggtccaggcaatccagccgccggaacctgtctggttctctacaaccacatttacgcccagctccttgccgagagccgtcgccatattacgcgctccgatatcggtaccgccgcctgctgagaatgggcagacaagtgtgattgtctctgccggccactcgccttttgctttcttcggagcttcggcctccccgcccttttgtgcttctgcctttgtctctgatgtaccctggcttcctgaacatcccgccaatgtaagcggcataaccgctgccaatgcaagcgccagtaattttgtagtagtcttcttcataattttccctttcctttctgatatatatatgtataaatataatttcaactcacgtccgggcaagtagccgatatccgctatattccggcgcgatttaaatcctgatttcttttgttcaattttgtcttatttttaaaattatcatataataacatggccaaatttaccaacagcttttccctttacctcaacagtcaaaaggttgtagttgttctttcatgcagtcaggatgtgacatttttctacagcacatttttctatgcctcgaacgcttcttaaatttaataccaaatttccatattaattacaagataaataattgatattcttcttccaatattagggaatttctgaattatttatattattaataattctttcacacttatatatcatttccacagccatttagctgttatcataataaaaaaacctgttggacattatgccactctcttttttatactgggattaccgaaaggaatttacagactattaataaaaatgcatacatataacattggaggttgaattatgacaaagcgtgaacgaatccaggcagctgtaaaaggaactaaaccggacaaattaccctattccttatggacccatcttccgggcatcgacctggaccctgccctgctggcagaaaagacttatgaattctacaaaacttatgatgtggattttataaagactatgaataacggcatgtacccaattgaagatttcggatgcgagattgactattcggaaattgccaaaggaggggttgccaaagtaaccaaaactccggttaaggaagcagccgactggctgaagctgactccctgtccgattacagaaggcagcctcgcaagggagctgacctccctgaagctcctgcttgaaaaaacaaaaggagaagatgttcctgttctgtttaccgtattcagccccataacgacggccgacaagatttccggcaagacgatgctgacccatatcagggaaggccagggcgagcttgtaaagaaggcgctggatattattaccgaaacaaccatggctctgactgcagaggccatccgccttggcgccgacggcgtatttttcgcttcccagatgagttcctatgactccatgactgcggaggaatatctggaatatggcaagccatatgatttaaaggttctggaagcggcaaaagacggctggttcaatacaattcatgcccacggaaataatatcatgttcgacatcctgaaagattatcctgtttccgttttcaactggcatgccggtgagactcttccggaactggacgaggctttcctcatgacgggaaaatgtctgatgggcggccttaagcgtatggatatcaccaacggacataagaatgagattcagaaccagatttacgatagttttaaaacgctcaggggccttcaccagatcctgactccgggctgcgttatccgttatccgctggatgacgaaatgctcgcgtatgtaaagagagtaaaagaatatatcgaagggagatttaattaagcaggtgaggacgccgccgcaggccagcggacggggtggtggggtggggttatgagtctttcgtctcgggggaagattgttgtggtttggggcggaggggaagataaagtctgcggagcacgctcccgctctgtgaaatgcatcgcgctgctaagctcggcaggacctcgctaatcagcgatggatttaggcggcatccgcagactttatcttcccctccgccccaaggccaggttttcgccgggacgaaagactccgccggggatatcggccccgtccgccggcctgcggccgctgattgtctcacgcgttaagtgcgggggcggaccttgtcgcggccactcagtgctaccgtgtacgggaaatacgatatgccttcattgcgcctttataaaaggcgctagatttggtatctgcctgcggaaacacgtagtagccgcgacagggccctccccatttaaggttagagacaatcagcgcccggaacggaccatgtccggtgccgcgaaaacttccgcctgagtcttccgtccctgcgataacctgaaccggggaagtaggcggaatcaattgcggaggggacatgggagtccgccggtgcttggcgaggtccctcacgagcttagcactgttgcgcactccaaagagtgcaaacggtccccgtagcaattcattccggccggattccccctccacaaccaacttcccacggggacggaagactcagccatccccctcaccacaccggacatggtccgttccggacgcgtcctccaacctcagttaaatctccattttgcttaaaccttcttatggacgggccagcatttttttcgtcatttcgatgaattccctggctgcttttgtctgatatttattcttcaggtaattgatggcaatcatcttgtgcgcattagggaaatccagaataaacgtatggatattttcttttccttccccgcccagcaccgggctgttctcctccacgaacacactggggcagatgataacgccgtagccggccctgcacatggaaaccatggtcatgatattgactgtctcgagcgccacaatgggtgtcatctggccctcgcggcagctgctttcaaatatctcgccgatccagttggaatgtttcatcttgataaaagggcagcgtgcaaagacctggatagggagcagtttcttctccagcagtccgccctgctcctcctccgaaaaatactcatccagtatattattggggaccacaatcagcgtatgttcctcgtgcagaacctccgtgcggatcttatcaggcgcatccagttcaaaaccgatagtaaaatccacgtcgcctttatacagcgcgtcggtaatttcattagaggtaccctccacaaggcgtatctgcacctgcggaaaatcccggccaaatttcatcagcaggggaggcagtatcacagaacctctcgtattgggaacgccgattgtaagcaccgcactgcggaaatcacgtatatcctgcaattccagttccgcctcctgcttgacatttaagattttccgggcgctcttaagaaggctttccccggcgtcggtcagcgtaagcggcgtattccggtcaaagagctggacgccgaaataatcttccagctttgcaatatgattactgagcgactgctgggagataaaaagtcgttttgccgccttagtgaagttcatctcctccgctgtcacgataaaatattttaaattcaggaaattcatagtctcagctcctcctgtttctctcaggtaaaattatacggggactaattgtaaattgcaaggtcaatctgacaacaaatcatacaggactgctgagtgcagtctaaacgttacagttcagccttcggccaaaccgcagcaaatgatgcacagaaacggcaaaaaacgccgttgattgtggtgaaaagttcacttttcatcgcgtcgcgccgcgccgcttaactcgggattttcgccaaaagcagcgaaaacacctcgcggaatacatcatggctgaacttttacgtctaaacaacagaaaggataaatcaactatggacaaaaaagtttataatacttatgtttctatcttaaagaatgaactcgttgtggctctgggctgtacggaaccgattgcgatcgcctatgccggagccaaagtaagagaagttctggaagccatgccggattgctgtgaaataaactgcagcgggaacatcgtgaaaaatgtaaaaggcgtaaccgtccccaattccggcggcatgaagggcattgacacagccgcaacccttggaatcgttggcggtaacgtaaaacggattctggcagtactcgaggatatcacaccggaacaaatcgaaaccacccagaagctggtgaaagagggattttgcagctgcggcctgattgaaggcgttgaaaatctctacattattatcacggcctacgccggggaggaatcggctaccgttgagattcgtgattatcacagcaatatcacgaagatcgtgaaaaacggcaagattattttcagtacggatgacgaacagtcggagcagtcctccggtccggacaaatccctcttaaatgtaaaagatattctggaatttgcagactgtgtggatctcagtgatatcagtgaagtaatttcacgccagatagaatgtaacaccgccatttcccaggaagggcttaataatccctggggcgcccaggtaggccggaccctgctggatactttcggctccgacgtcgccatccgcgccaaagcggctgccgcagccggctccgatgccagaatgagcggctgtccgatgccggttgtcatcaattccggaagcggcaaccagggaatgaccgtatcccttcccattattgaatacgcaaaagaatataacatttctgatgaaggactctaccgcgccctcgtggcgggcaacctgatctccctgcaccagaaaaagtatatcggcagcctctccgcatactgcggagccgtaagcgcggcctgcggaagcggcgtcggcatcgcttatatgctgggagcctcctatgacgagatctgcggtattattaccgacactatcgccacaatcggcggtatggtctgcgacggggccaagccttcctgtgcggcaaagatcgcatcggctgtcgactgcgccctcacagccttccatctgagcaaaaacaaacgcgttttccagcccggagaagggcttgtaaaagaaaccgtggaagataccatccagagtatcggccgtatgggacgggaaggcatgaaggccacggatatagaaattttgaacataatgcttgagaactgatagaatattccggttaatgatatgccccttaaatctttaccgctgataacgaaaaagagtcctgtatgccggactcttttttcgatctctgtattttctgctgcattctgccgccgcagtgcgaccaaataaattgtcatttttcagataaagtttgacatgtcacccttttcttgtcattttttgtcaaaatatgcactgataaaatccaattcaagcactaattccctctatattcactgataatatatgaatttatagacattatcaccataaactccataaatggcatgaatattgctgatatagaatatcgaagatgcatcttcaaaattgtaaacgtctgcagcgtacaaaaaaattgaaaaggagagcaaatgtttggggtaaaaaagagaaagggcaggtttgaggctccacatgtatttgtcattttattcacactgattatcgcggcatcaattatgacctatctgataccggccggtcattttgagcgggtagaattagggggacgtatggtcatcgatccggagtcttttgtctatgtcgagcaaacgccggtgggaatttttgcagcgctgaactgtataacggccgggatcggtgaagtatcggaaataatcgcctttctcctgattatggggggaagctttcatgtaattcagtctacagatgccattaaaatcggcataggacgtattgccgtagcaggggcaaaaagcggcagggacaaattcttaattccagtcttaatggcagcatttgcagcggggggcgtcgtatttggcatggcggaggaaacgcttccatttatcgcaattatggtaatcctggcaatgtccatgggctttgattccatcacgggcgccgccatagcgcttgtaggcgcctgcgccggcgtctcctgctcagcgatgagcccgtttacagtcggggttgcccaaacaatcgccgagcttccgctgttaagcggctggcagtttcgaatgtgttcacttgttttcatgtttacgattgcagtaacctacatataccgctatgcgatgaaggtgcgcaaaaatcctgaagcaagcctgatgtatgagcttgaccgggaaagaagcgatattctgaatctggaagatctggaggaactgacgggaagacataaagcggtactggcaatctttttcggcatgatggttatacttgttctgggcgttatgaaatggggatgggggatcacccagatgtcttcactcttcttggccgcttccatcgcatccgctgccgtattcagaatgcgtttcaaccaatatgcggtaacctttgcacagggcctggaatccctggccgtcggggccacggtcgtgggactgtccagagcggttctcgttatcctgacccagggaaatataatcgatacaatattattcagctcctcttccctgttgtcccagattccggcggcagtctccagcctggggatctatctgttccaatgccttttaaatttcctgatcccgtcaggttccggccaggcagccgtttcaatccctattttagcccctctgggagatttaatcggcgtgacgagacagacaactgtcgttgccttccagcttggagatgcaatctccaatatactcacgccgacttcgggatactttatggcggctttgtctcttgccaatataccgtgggaaaaatgggtaaaatggattcttcccctgattggactgcaatatctgggaggtgctgttgtcgtcatgattgcccagttcatccaccttgggccattttaaaatctttcaatataatcaaaatcaggagagccgggtgcgtcaatgggaaaaagagaaattgaaaaatatatactgaagaataaagaaaatatgtaccggattagaaaagagctgtttgaaaatccggaaatcggcctgaaagaaaatatggcctcagaactgctggcagctatgttccgcgaagagggcttttctgttattaaaggaatctatgggctggaaaccggattcagggcagagtacgcaagcggcaggccaggtccctcaattgcgttcatctgcgaatatgatgcattgccggagatcgggcatgcctgcggacataatataatcgcggcaatgagttatggcgctgcctgcggcttaaaatcggttctggatgacattggcggcagagtagtcgtattcggaacaccggatgaagaacgtacaagcggaaaggtgaatttcgtggaagctcatgcctttgataacatcgatgctgtcattatgtgccatccctgcaccgaatccgaagagagcggcaccacactggggctgggagcgcttcaatttgaattcagagggatttccgcccatgcagccctgccgaaggaagactgcagaaatgctctggatgcgttggtaatgtcatatctgaacattaacaatctaaaacagtatattccgggtgccaacatatacggcattattgataatggagggagccggcccaacataatccccgactatgcctcgatgaaatattatatccgggcagcgagtaagaaaaagcttcaggagtatatggacagagtggccgcctgtgtgcgccatacggcccgggcgtcgggagtgtcggttgatgtaacggaatttgaaaatcgggttgaaggccttgtgacaaatcataccctgtcagatgttttcaaagaaaattatgagaaattgacaacgctccggctgaaaaaaccagaaacatacgcagctacatcagatattggtaatgtcagcaatgttgtgcccacgattcacagctggatcggaattacaagcgccggcggacccgcattgcataatcctgaattcacggatgccacaatgacggattttgcagccggagaaatgctgtctgctgccgtcgccatggcgcagacggggtatcaggtaatcaccgaaccggagctattgcagaaaatcagactggaatttgaaaagtaagagagaatcccgcgagcgggattctcttactttctgttaagaaagtctaagcggcgccccaggtccgaacgggattcccagtatgaaccagatcagcagctgtattgtcataaagcagaaaaatgcaattgtataaggcagcatgttagccatcagggtaccgaatcctgcattcttgtcatatttttgtgacagggcaagaagcattccgaagtaggcgaaggtcggacagatcggatttgtaatggaatctccgattctgtaggccatctgcgccaatgcgggatgatatcccagaaacataaacatcggtacaaatataggtgagagaattgcccacttcgttgaagcgccccctatcagcatattaattaatgcgcacattataataaagagtaccagcacgaccggaatcggcagtccggaagcttcaaggaaatccgctcccttgattgcaagaataatacccatattggaccactcaaaatatttcaggaactgggcggagacaaaaatcaaggctatataaggtcccatatcggccatcgcctgacccagcgctctggctacatccttgctgcccttaaatgcccccgatactttcccgtaaacaacgcccggaatgaaaaacaggagagcgatgaggaagggaagtcctttcatcagaggcgcagcggaagcaatcggcgagcctgtttccggatccctgagtatgccgtttcccggaaccacaccggcgagtatcaccgccagatataccgcaacggcgataaccgcccatttcagggcctttttctccgtaccggttaccgcgctgacctcttctcctgctccggttccggtatactgtcccagacgcggttcaaccaccttgactgtaacgaaaaccgccatggccgtcagggtaaatacggaaaatgcggaaaaataatagttgatggcaggtgaaagcgccatatccggatctaccagctttgccgctgtctccgtaaagcttaagtttaccacatccatggaggtgacgagtaaatttgaagcaaatgcccccgataccgcaccgtaggcgcaaagcatgccggccagcgggtttcttcccatagccaggaaaatgatagctcccagaggcggcattacaacaaagccggttcctcccgccgcatccgccataacacacataaatacaaaaatacagattattttcaagttggagcctttggaattctccaccacgtttctcaatgctaccgagaaaagaccggctctgtcacagactccgactccaagcatgcataccagaaccattccgagcgccgacaagccggtaaaattgctgactgccgttgttatcattctcaccaggccttctgccgacagcagattatagacggatacaacttctcccgtggccgggttgacgcctgagaatccgatttttgaaagcacaaatgaggctgccaccgtaatgatggaaagccatacaaaaagcatcatgggatccggaattttattccccatatattcaattcctgccaaaaaacggttaaaaatgctgtttttttccttctgttgattcatactaaccctctcctgtaattacatgacgcaaagcgccgtttttattgaaggcggttgtctgtacgttccgcctgttacatgcattctatattgagcgccgccggatttaatgatatacttcagaaagtacgataactgaggaggcgcttttttatgattaattttttaaacctgcaatattttctggtgctgtgcgaggaaatgaatttccgcagagccgcccggaagcttcatataacccagcagtccttaagcggccatattaataaactggagactagttttggcgtgcctctctttgaccggaagcagcccctgaccctgactcccgccgggatgtacctgcgtaaaagagcagccgagtttcttgccatgcaggatgacctgcaaaaagagctgctggacatcggcggcatgatcggcggttcactgaccgtcggaagcacccacgcccgctcccaggtccttcttcccgccgcattccgtgcattccaggagaaatatcctcaggtgtcggtaaagctcttcgaaggctcaacggacgaactggagaacgggattcgaaacggcacgctggatgtgagtatcggttacctgaccgaaggttccagtcagattaccacgattcctctctatgaggaaaatattatcgtcgtgatacccgataccgtcattgagcgttattttcccaaccacaccgtcctctcaaccagaaagccggatctcagttttgtgatgagctgtctggaatcatgcccgttcctggccatgacccagacctcgagaacacctacatttacaagacggtatctccagtacctgaatatatccccgaatatttttctggaaacgaaaaatgtaggaacgctgctgtccttttgttccgccgggctgggagtatccattttccccgaaacctttatcacctattcccaatatgacttctcacatcactgtttttacacgatcgaggactatgattcaaagaatatcattgtgctgaattacaggaacacacgatatctttcaaagacaatccaggcattcgtcaatacggtacgtgaggtggtggatgctcagacgggactgggcgctaatcgctaatctgcacgctccgcgcgcaggtcaccgcattcaatgacaatggctcccgtatcgaaccgggtgagcagctcgcagccgtcctctgttatcagaacagtatctgaatggcgaacacctccccaggttttatccattaatccaggttcaaccgtcatcaccattcccggctggagccgcagcaggttgccccgctccagggatggaaactcgtgcgcggagcagccgactccatgccctaccctgcccggaagaatggaatcaaagcctcgttcagagtaaacctttgccgcggcaagatacagctcctcaaacgtcactcccggtttcaatatcctgaaaatgctctcccgcgctttaagcatgccgtcataagcattctgtttataggaatccagttctccgactatgaccgttctctcattctcggcatggtaaccgtccgttttggcccacgccatcggaagcgtcaaatcaccaggctgcgggtgataatgcctcgggcagtcacagccatatgcaatgtgtccgttagaaaggcaccatacatgaagactgtctatcattccgccttctgaggttccgaagccgcagacttccgcctccggaaacttctcatgccacattcttctcattgcatactgtccctgggtacatgcctctgcttccgagtatccctgcttcaagtaatcaatcgtgacttcgactcctttatcgaccagggctgcggaacgtctgatgcatccaatctcatatggatcttttatgattttcatcatatttatttcagatgaaatacttaccacctcatcgggacaaagcttatcttccacttcactgcagaatccggcgctgcagtaatcgagctcaaggcccagctttctgtttcttttccccagaagtgtcctcaccgcgtcgacaggatgtattgcaagcggaacattcgccccccatttgccgtatattttgacattcttgatctttccctcctcgcatgcgtggacgtatcggatcgaatgcaccagcaaacacggttcttcatcaagtgaaataatcataaccgccggatggctgtttaataccggattaaaattactgaaataaaagacattctccggctttttcagtatgaccgtatcaatgcctttttcagacatgatgttttttaatctgcctatccgttcatctatatactttttgcaatccatagtatcctcctatttcaacagtgcatatttcaggctgtcgcacgggtttcccagtgttgtccacgcctcgccgtcctcaagtacaaacaggcttgtggagatggtcctggatggcgccccctcctgcgggtggcggcagattgcattcactccgttctcatggtcggacatgatacggaataaatcctggaatctgattcttccgtactgcttcccaagcatctcctccattcttctgtacctgaagtaggtggacggatactctgtttcctccggattaagatggctgagccgttcggagcggtagtgattggtacggaataagataccgctaccattatccttttcaattgaaacctcatctctggtcatttcagccagccatgcatcttcccggtcgacaataataatattcagtccattcatgcggggcgaattcttcacatactcaagagcttccccggctgtcctgcattttgccagcagaagatggacatttaaaaagatatgggaatactctgccgcttccagatccgagggagccttagccgaccagaaaccggttgttgtgactccgactccgtagctgttcatcccgctggccggataggtgactgtcccggcgccgtttatctccactattttcagtccgtccggatattcccgttcgattacggcctgctctatataggtgctcatatccctgtttttaatcacataggtacagccgtccgctgtcgcctttcctcttgccataatcatgctgcattcctgattaaaatatcccgtcatgaaataggccggtatattcagcatcagaatatcatcaaacggaatctctgctccatccgatattcctttcatttcctcaaatatatcactgtgcgcctgtttcaggaaagcggcgttctttttaacaaattcttcataacggaccatgtcaacatgatccgatgccatctttttgccgacctcccggatattgtggagaatgacttcgcgaagctccgttccctgcattacgccctgttcatacggagttcctttcacttttaccatactgttcatgcttttacgctcactaaagtcctttctgtattgagtcaaattacctgaaattcttccggcgggatccctgatatttatcgatacgttcattataggcgcagtccttcccttgatcaaaaagttatttttcgtcctccctgacagttttttacctgtcaagcttcatcggatgcagacgaatacacgggcggagcgcctgaatgcaatgataaacggctcgttctgccaccaaaaaagggcctttcatccgcagctgttttgcgcagatgaaaggcccttttttctttcacatattttctttcataatccgaataaattcctttgccggcccgctcagcatatccttagaatcataagcaaccgccatcgtccattttgccccgaactcttcctccatccggcagaactgcggctctaccggacaattaaacagagatatataattttccggcatgaacgagacgcccagtcctacagccgacaggcacatggctgtctgcacactgctggtattcagacaggagagaggctggattcccgccgccgccaatatctgatccgctatctgcctcaccctctggtaaggatatgccaggacaaatttctcgcccgaaaaatgcttcggatcgataaatggatagggactctcctcttttttgtaaaagaattcttccagatggctgtccttatgcagcaccgccacaaaattattttcacggatcggaatataggatatcgcactgtccttgagcgggcagtgaagcagcccgatatccaccttcgacgcgataatatattcttcgattttctgtgacggcccttcttccagcctcagctctatgttcgggtaaagctccctgaaaatcgggagtattgtggaaaagaccatggagcccagatgaatggtggtcccaatcgtcagccgtcccttcctcatattgctgatctcacacagccctgtctcgaaatcattatacagcttcacaatttttctcgctgtttccacatactgttctccggcaaatgtcaggaccaggccatgctgcgtgcgccgaaacagcggcatgtcgtgctggcgctctatcctcatcaggcactggctcagatacggctgcgatacatacagcctggcagatgcgcgggagatactcttctcctccgcaatcgtcacaatatactgtaattcttttaatgtcatttgttgtccctccctggattgtcactgcccgagtaattttcagccatgcgaaataaactgcaacgataacctgcacgctccgcgcacaggtcaccgtcatcaacaaaggcagggtatcccatctaaaccggatgggatatcttgcctctttttatttcctatttcattataacagatttataagctgagccggattaactttcgtcatgaggttcagctcttcctccgtaacgccatgtcccagcagatactgcaggtactcctccatcagtccgggccaggacggcaggccggtatttccgcagtccgttgacaataccgtgtccgaacacccaagctctgtcaggttcttgagtacatccgcgtaggaacggctcaaatcgagatagacggcacagcgcaggaagtaaacgccgaatatctgcagatatctctgctgccagacagtcagcctggtaagcgcaagctcgggatgatcgatcacgatctttttgaccccgagatctcttgctctctcaatcacgaccctctgctcctcaaatgagagatggcctgtcgacaggataacatccctgtccgctatcatgtgcagaatcgagtcaagcccgttgtccactttcccgtccttcagggcatgcagccctcccggaagattaaaatactttctgtggtttgccgcgctttttgtaggcatccataccgttttcgcaccaaggttaagagccgcctccaccgcagccggattaaatccccccacctcatcattcagcgtgatggaaccaaaaacggaaaagcccgtcagtcgggaaacgatttcagcccgcgccattgtgggaaacgtatgcgatttcagtacgactgccgccgcttgtgcctccttcatctgctcagcaagttccatatcggtgaattttctgggctgaatgtcaggcgccggatgaacgtgcaattctattactccgtttaaaagatttctctccaccatgccgtcaccccgccatcaatccgggaaggaataacgtgatttgaggaacaaaagcaaatagggaaatcataatcaatgccacacagatatagggcaaggctcctttgacaatctcaacaaacgtcgtgtcgcagaccgccgccgcggtaaacaggttcatgccaaatggaggcgtgatcagtcccattacgagcgcaatgcagaaagtaacccccagatgaagcggatccattcccagttgaacgccgatcggaatcaggatcggagccaggataaccaccagggccagcacttccataaagcagcccgctatgaaaagcagtattaagagaagtaccgtaaatacgaaccggttgcccagatacggcaccagcgcattggccacagtcgtcggtatcttcgccgccgacaaaatccacccgaagttcgcggacatcgccataataaacatcaccatgccggaggttacgatcgtcttcttcattgcgctgatcaaatcggaaaatttcatctcccggtatgcaattccaagtaccagactgtaaattacgcaggtgacggccgcctcggtgggcgtaaagatccccgtatatatgccgcccaggataataaccggaagaagcagtaccggcaccgcctggataaaagattccattacttccttccggctgtacttcacggctgacgccgcttttttgttcctgttcatcaccagattaaccgctacaaaggatgcagccagcaaaaggccgggtacaatggccgccacgaacatctccggaatcgaaacgttcatcgtgctgccgtatacaatcatacagatactgggcggaataaccgggcccagggaaccggccgcagccagaataccgcctgtttccgatttactgtatccgtttttcagcattgcgggcagcatgatagccccaatcgccgcaaccgttgcagggcctgagccggtgagggccgcgaaaatcgtacagcagacgatggtaacagtcccgacgcttcccggcgcgcctcccagaagcttctcaatacatcctaccagacgctttgacaggccgctggactccatcagataacctcccagcgtaaacagcggaattgccagaagcggaaagctgtccgtaccgagaaccgtccgctgcgcaatcagaatcagcggtttcatctgtgttaccatcaaaaaaacgctgctggatataccaatggaaaatgcgatggggacgccataagccagaagtatcatcatgactcctaataacagtgctacttccatctacctcatccccccttctccatcgtccgccccctcctgtacaagggcagatgattttgcctcatccattctcttaatcaggttattgattccattcagaatgattccgaaggcccctgcagggagggagcagtaaataaccgacatcgggatatgcagggtcggcgtaagctgcctggtcgtcatggccgccattttaatcccctgtataaacaggagtaccgcacaggccagaatcaggatatccaccgaaattttatgtccgcccttcattctcccctttaaatgatcattcagaatcgtcaccgctgcatgcgaatcggatgagacgcaaatgctggcccccagcattgtcatccatataaaacaatatcgtcccagctcttccgttcccgacagggaagaacccagcacgtaccttgtaaatacctgaacagccatggctccggtcaggacagccaggaggagcagggctgctcctccatatattctgtttaccatgctgcatactttatccaatgcatctttcataggacttctcctcatccggctctttactggatttctgcgattttctcgttaatcttgtccagtaactccttatttacatccgcagcaaaggcttcatgaatcggctttaccgcatctctgaactgctgtttatccgccacttcattcacctggactccggcctcttccatctcttttaacagcttgtcgtctgtctccttcgcagacgcgcgctcttcttcagccgcttttttcgccgcctcttcaaaccagcccttctcctcatcgctcaaatcatcccagatgaatttagacacgctgagcgtgattggcgaatagaaatgttcggtaaaggaaatatagtcgcagagttcatatgatttatatgtatacatcggtgtaaccggctgctctaagccatcaatcgttccctgctgaagggctgtaaagcattcactggatgccatcgttgtaggattggcccccaacgccttgaacgtatctacataagttgaattttcaggcacacggattttaattccctttaaatcggccggtgtattaatcgggcgttttttattgatcgtgcttctgaatccgccttcgccccagcttaagattttaacaccgaagtcattataaagttcctcctccattgcatccgttatggaggtatcatccagtaccgcgtgagcctgttcacggttcataaacagatacggcaggtcaaacactgcaaagtcggggacagaagagctgaagctgaaattcgtgatgacagccatatcaattgtacccatgttcattccttccatcatggaaagctcgctgcctaactgcgcatccgtaattacgtcaattgtaatcgccccgcccgacagttcctctatctctgttttaaaattcattgccagtgtatgatagggatccacatcctgggccggatcaatatggccaagctggatcgttctcttctttccggacgttggctcaccgggcgctttatctcctgcattttcctgtgccgtctggggctgcgtgctttttccggcgccgccgcctgacgaacatcctgctaaagaagccgccataataagtgacatactgattgctaacatttttttcatagttttctccactccatttcttatgttttgttatattataatgagcctgtcctctaattaaaagccggcgcctcaccacaaacatgtctggattcctccgtaagccccctgcttttgtcggccgccacatggtctataaaccggctgatacattcattgaatttatttgactcgtaatagaacatcatgtggccgctgttataaaatttattcagctccacatatcccctgatctgtgaggcaaatgcatccaccatctccagcccgtaagcgtccgacgaaccgccgaaaatagacacgggcaccgtaagcttttttaaattactgtaattatcggtatggcagaaatcataatggaattccagggccgaccacggcggcgtcttcataaattcctccataacccattcccgatcctcctgcgtcatagctccgttggaaattctcgccacaaagcgctcgtaaaagtcatctctgtcatacacaagcggcatataattatcaagccagttatcaatgttataattccgggagcggtgtttgttccattcgtcgggagacaccgggaacaaagaaccgtctatcagaaccagtcccttcaggtgagcctcctgtgtcatcgcagcataggatatcactacggacgagcccatggaccagccgcccagtattacgtcttcaagctgcagatgttcaatcagatccctgatatccagcgcatttctctccatcgtattgccgccgcatactttaccggaacgcccctgtcctcttggatcaaagacaattaccctgtatttttttgacagttcttcgatgtttttccgaaaaaacttcgttgtcgccagaaatcctggcatcagcagaaacggtactccggttccctggtcttcaaaataaagaaccgccccgtccgacgccgtaaaaaagttacttttattcattgtcttgcctttctgataccggtataaatctataatcgcagctgtgaatttaataggttcagtatatcaaatttaaggtattgcaacaaagacttaatctttatccagtatataacaaaaatattatatcgactgtaaaagcagacagaatatttatgtaaattttttccaaattttctgatggagatttaactgaggttgggaggacgcgtccggaacggactatgtccggtgtggtgagagggatggctgagtcttccgtccccggttgaaggtggtcgtgtgggggaatccggccggaatgaattgctgcggggaccgtttgcactctttggagtgcgcatcagtgctaagctcgtgagggacctcgctaagcaccggcggactcccatgtcccctccgcaattgattccgcctacttccccgggtcaggttatcgccggggacggaagactcaggcggaggttttcgcacaccggtcatagtccgctccgggcgctgattgtctccaaccttaaatggggaggaccctgtcgcggccactacgtgtttccggcaagctgatatcaattcttccgcaatttttataaaaggcgcattgaaggcatatcgaatgtttcgtacatggaatcgcagcgtggccgcgacgaggtccgccccgcacttaacgcgtgagactatcagccgccgtaccggcggcgtcctcacctgcgcagcccgttccttcttttcagcgctatcttttttacctcccctgttgtatacttttcttaagaacccccgatggaaaaggaaaccacaatatgtctgaacacaaaaaaagaagccgtctccggcttgtgctgccggctctgtttttattaacagtcattctttatctgtgccggaagccggccggaacaacagaacttatcatggagcatactccccttgagacctccttcaccattatggaaagcggcgtccccggaaataccattctggttgtcggaggcatccatggggatgaaacctccggatggagggccgcggacaagctaaagaaagtaaagccaaagaccggtaccctgatcgtcctctcccctgccaatgcaccgggaagccgaaagggagagcgtaacgtagaactgtaccgcgatctaaaccgctcttttccgggcggcaaaaaacgggatttgacagatgaactggccgcttccatctatcaaaaaatcattgaatactcccctgatcttgtcatcgatctccatgaggcgtcgcgcgaaggggatagaagggattttctgggaaactctctgattatcacagattcagagaatattgacgggctgattttcgacctcctgctggaatcccaggacggttcgcttaatacctccgccccctttacctgctataacggaacaccgaagggcagcctgaaccggaccgtgactgagacgctcggcattcccgccatcacggtagaagtctcacaggaggatgatccggacatgcgcatccggaatcatctggctgtcgtccaccggattcttaagttttattcgatggaatgattatttaagtcgagaggacgctgccgcaggccggcggacggggtgatggagttggttatatgagtctttcgtcccgatgaagggctgtcacgtattggggctgcagggaagatctagtctgcgggacgaaaggctccgccaggtgtatcggcccgtcctctggcctgcggccgctggttgtctcacgtcttaagctgggtgggagcttgctgcagcaccaaaaaagggattttcgtgcgtatatttcacgaaaatccctttttgatacttcacttttaaaacagttgttctttttcactggatatgcctagtggcagcggcaggatccgcgtcccaccacaccggccgctgtccgttccggacgcgtcctccggatctcaattaatatcccacagcttttccgtcacgccttgggtccgcaccgccccggagcgttccgtccggcagcatctctaccgcctgtacgcatggataatccatccagtctccggtttccaggaccgggtggcccatggctttcaggccttctattacattcttgtcaatccgtgtctcaatcatgatcgtctcgtcgctggtcgtccagtcggagcctgcatggattcgcggcgctgagatggcgtcctgaatgtccatgtcaaagtcaatcacattggagataacctgggcaactccggagataattctctgagagcctggggcgccgattgtcataaccggtttgccgtctttcagaatgatggtcggggacatggaactcatcggtctcttgcccggctgtacttcattggccgtgccgacctcagcatcaaagtcgtccatttcgtcattcatgataaatccgtatccctccggaacaatgcctgagccgaatacatagttaaccgtctttgtcactgcaacaatgttgccctgcttatccatgatagagtagtgagtcgtctgcggagactcataggcccatgcatcaccgtgttcaaagacctgggccttctcaaggtcgatctgggaagccagctccttcgcatattcttttgaagccattcctgtcaggggcacttcgataaaatcagtgtcggcggcaaagaatcctctgtccttatatgccattttcattgcttccgtcaatacatgcagatgctccttcgaattatgtcccattcccttcacatcaaagttctcgagaatgtttaaaatctccacgatcgttgttccgccggatgaaggcggcggggaggaaagaatctcatagcctctgtaggttccgctgaccggagttctgagcttgatatcgtaaccggccaaatcctccattgtcagaattccgcccgattcctgaaccgctttgaccatagcctcggccacttctcccttgtaaaacgcatcggctccgttatcacggatcatcgtgagcgtctttgcaagatccgggtttttaatcacatcacctaccgaatatggatatccgtccttcagatagatatcgccgcaggctttaaagcgggtgagaacctcgaactcttccatcatgtccctgttcaatacggccgatacctcatacccctcttcagccattttaatggatggattcatgacctgttctctggtcattgtaccgtaagtatccagagcatacagcagtcctttcacctctcccggtactccgacggacgggcctcccagccatttagtatcatcggtcagttcaccctcctcgtcaaccggccacataccgggctctgcctttgccggagccggctcacggaaatccacgaaaacattctcacccgtatccgcggaatggatcagcataaatccgcctccgccgataccggatgactgtggctcgcatacaccgagcgcaaagccaacggctacggccgcatccacagcattgccgccggcctcaataatatccgcgccaattttggatgcctcatacttaccggtcgataccacaccgtttttgccgtttccgtcgcggtcgtctctcttaatctggccattttcgtcgtaaggtttccagccctcttcctccgctttttccgtttccgcttccgtttcttccggtgcctgcgtctgaacggccgattccgtaacagcctctgtcgctgtcggcgcagccttctgacagcccgttacagacatggacgtcacgagtgcagccgttaacaggagcgctaaacttctctttctcatatccatttcctcctattttctataaaaagcctcattgtgaaaggcttctttttataatccggcggtgaaaccaacatttcaccgtaccgccgtttcgtctagttcagatagcttcccagtctcgttccccccagatccgtcccgtctgagctgagaaacagctccgtataggtcggaaccccggaaaataccaccggtttatcgggatacaactggttgtaggcattggtatattcaatcacaccctgaaggtgtcttccaactctctcctcaatcggatgaccgttctcgtcgtagggaacatagagaaatcccagcttcgcactttttacatatgccttatcttttccggtgagagccagagcctcatttgtcgctccgcgcagacgtccctgagacgcattagccgtctccatcagcagcggaatcgtatccgtatagtcgcccagttccctgtgggtcagtccgtgcagattgaccggagacggctccagcgacatctggattcctcccagagtcagctccatcataccggccgccgccagcgacatccccttttcgtgggatacggtggcgttgataaccgggtattccggtgatgcctcgtgaagatcgaacgtctcgttgatatcctccgcccggatcagctcagcgattgcataagccgcctgctccgtggggtttccgtccggtctgcctggataggccctgttaatgtttcttgtctccgagccggaaagctgctggcccgatgccgcgtggacatagacatccggatccggccactgatccaccggattagaggccctggagccataccggaatttcctgacaccgctgggcgtcgtgatattcaggtactgcggggatgcctcctgcgggtcattgtgcgtcatcccgctccggtttgtatagggaattacatagacggttccctcctccacctttgcattttctataaatgtgatggcagccagatagcctgccggttcatttccatgggttccgccgaggattaagacttttcctcccggtttttccccctccagtatgtaaacttccgtgtccatactgcttccctttattccgtcaaaatactcggaaagcatctttgtccctgtcactccgtctcccggcttaatctcgcccagatctttgagtgacgcaaaatttaatcctgtcaccacggtcacagccagcgctgccgcaaggcagacagccgctgttatatgatttttcttcatgtctgcctccctatttaatcatcaataatcttaaaataagcggaatcactacgagcgccgcgttggcctgaagcgtgattttctcttcgtcgaacaggttccaaatggtaaatattaaaacaactgctataattcctcggtaaatcaatgtaatcatacccggttccctccccctctatttaatcacaatatacggcgccagtgaatttgccaggagaataaaggcaattccccatgcaatgatcatcagggaggggatcatacactttttcagcacttttgtgtatttatcaagacccaccacctgagctgcgaagattccggccagagccgtaggcggcatcatatctccaagggatgcgatcagcgagattgccgcagcggtgataatctggtttttgctcagaaatgccagaaggaacggaactccaaggacagaggccgatccgtaggaggacacggctccgaaaagcggtatcgtaatcgccatcgccacatataagaagccgtccggcaggctcaggcaggttgtcacgataaatccgcggacaccggtcagcgtcatgatctggatgaacattccgactcccatcaggatacccagaacaggaagcacgctgttaacagcatccttgcacacctttgccacattgattttgtaaccggtaaacaggccggtcacggaagcaatcatgaaaatcagcggcatccccaggttgggaagagaaggcaccgtcttattcaccaccatgagaatcagcgccacgaaaatcggaatatagattttaaacccgaatttctctccaggctcctgattcagcttttcccggattacatcgtattccagttttttcacatatttgaggccgaacatcagggcaaagataaatgccagcggaaatgtcagaagcgccagcggaagttcaaaaccgacataaggtatgtcaattccgcctccgataatcatggccggtatattgaccggcggcgctatcatacccaggatgcctcccatagccaggatacaggccgtctcaagctgcggaatccctatcagcatcagcaccggagccataatcgaaccggctgaaagcactgctgccgtggaggaacccgtaatcatgccgggaaacataatcaccagcataatcaggcagaccagaagcgacggcgtcttgtggaatttcttaatgatcagtgaggacagcgcgtcaagcgcccctgattcctggattaccttcataaaaatcattgccgtcgtgataacgagaatcgtatccacataagagaacgtgccctctatcagatgacggagcggaaagccgtagcctcccgtcagagcgccgattaccgccgccagcaccatggaaaggcttacaggaagtttcaaaagaaaacatcctgccacgaacgtaattaccatggctaaaaatataattaattcgatgctcatatgtaccccccggactgtttatttgaatgcggcgccaagctttggaaccacgtcggccatactgctgacctcgtcaaacggaatgcccgctttagccgcaatccctttcataagtccgtccttatctccgtctgcaactacgattgcataatccgctttttccaggctgggagcgatgaatttatcggaaagctcgcctcgtcttgcctctccgccgacatgtaccgcaatcacgataattcctttttcttttgccgcgtcaactaattcagtcacccgctccaattcgccgtttgcatcgattcccgctgctccgagtcctttggaagaaccgcccactgccagcatcagcgtcttaacgccgtctaaatcggccgacgtggccaggctgttcttttcacacttaatatcattcttatcaagcatcgtctttaccatttcataatccgcgctctggcctgccgatgtcagaagcaccggctcttctgcgatggcctctgtcaggccctgcacctctgcctgctcctgtgccgcatcaccggccgcctgcgccgttgttaccgcctccccgctttccggagccgctttctggccgcagcccgcagccgctaaagagattgccgcacacattaaaactacaattgctttctttttcatgataccctcctgtgttatgtttttgttaaaatcatagtatcataggcaacttgaaacttctattttttctcttatttatctctcgttgaaatatacaaaaaaagagctgttttttcgtgattttatctataaactcacgctaaaacaactctttttccaccatattaaacagctcaaatcagccggtagctctgttttggcctccctttttttccgtaactgctcttcacatccaccttttcaagcgtggtcaggtactgaagataacggtatgttgtctggtaggccagccccgtccttccggaaatctcctcaaccgtcagatactgcatctcaccgctcatggcatctttaatcagctccatcgtggaactgccaatccccttaaccagatacggccagttatcgttcttctccgtccgtttactctccatcagcctgatatggacacgtattcttgagataatatcaggagccttaatcggtttcgtcgcaaaatcgctggctcccgcttccaggaatttatccgcgacgccctgatcctcatctatcgtgaatacgatgatcggtatgtccggatcctgcctgcgaaacatttttaccccctccaccccattgatatgcggcatatggtaatcaatcagaattatatccggcgaatcagttttatagatttccaatgcctgtttcacgttctgggcaatcagcccggtccagccctgtgtctcaatcaccgccttcagcgcataaagtatctccgcttcatcgtcaaccaacagaattttaatctccctgctgctcattctgctcctccttatcctccggcatcaaaagttcaatgctcgtcccctttccaatctcgctgtcaatctctatcgttcccccggaatccgtcacaacctttttaacaaagctgagtcccagaccatgggagctgcgggtggaaaatccccgttcccagataagcgacagcgtgtccccgtcaattccctttccattgtctgatatattaaaacagaccgattcttcctcttcggaaataacggtgctgacatccaaatcaatccttcccccctgctccgccagggcataaaaagaattctcaatcaggttaatcagcgctcttgaaaaccgtattttattcacatgtatatatttctccggcgcctggttatggacatgtaccagctccgaatattcggaaactgaaatctgggccagaaccgaatcaagtatttcctccgtcgaaatccgggtccggtggttctcatagagaatttccgatatcatgctgctcatcttctcaatcgacgattccacctggcttaaatatcccgactccttgtccatctcctttttatcgcaggtcatccgcaccaccccgaccagcgcctgggccgaggtcagaggcgacttcaaatcatggaccagatgtctcatttccagatatgtgcggttttccagcacccggagccttgtgtccataatcatcctctcattctgcgctttcagctcattcatggccttcaggttattctcatcccggatgagcaggaacagaaggatccccataaacataagcagcgcgaaaaagatcgccaccgtaccgttcatctccggctccatctccagaaattcggctatcagtttgatatccttcgacatctcccctctgccggtaggcagtccctttaagcagggcatgatatcgagaaactgaagcgcagacaaaaacaccagaatcagcatggctttcttccacaggctcacgtaattgtaatcattctttcccagcagaatcagcagaataattaatgacagggcaggtatgccaaaatcatatttaatctggtggacattgctgatgatggtataaatgattggaattatacaaaagacgattcctgatttcagccatttggtaatcttatgatcgctgtccacctcaatagactcggcaatgataaacgccccgaaataatggggaaaggcccggatcgaattaagcgctcccaacttcattcccgctgtccacaattccagcttatcccgtgtgacaattgcgtcatatgctttttccggaatttcccacatatttatggttagaaaaaacggcatgcatatcccaagaatcagcaggatgcagccggatataaacttctttttattaaaatacctgacccggattttcataacatcccccatatgtattacaccgtaagtatcatgaaacagtcttatcatatcatattggacggcaaaaaaacagctccccttttattccgatttttcacatcacttcctgcctctgtgcattaatcgagtaggaggcggtgattaaccgccgtcctctcacaccaccgtgcgtaccgttcggtacacggcggtttcaacagttgacgtgcacagactgataagctatggctaaatcataaaagccactgcttatcagtctttcttttgtcattgccatatttaccgctaccgtttgcgtggtaaaccaatatcctctccggctgtttcctgcctgccatgccaaatcttccggcactcccattttccgcaggttcttcaccttggttctcggtttcttccattgtttccatatacacattcggattctgtggtatagccacttattgagttcttctattcggttcttcatttccgcaatcccgtaataattcagccagccacacatatacacttttatctttgctaatgcagagcgtatgctctgaactgaccttcgggaactaagttctttcagctttgacttcattttcttccatgactttccatgaacccggacatatatgccctttccgttctttcccaatgtaaagccaaggaatttaaaagttcggattgcaaacacgctgactacacggcttttctcttggttcactttcaatttcagcggcccttccagatatttcgtgctcgtctccagcagtctcttggcagctctctcgcttttcgccagcagcacgatgtcgtccgcgtaacggacaaatacaactccacgcttctgatactcctggtcaaactcattcagatagatgtttgccagcaggggggaaagatttcctccttgcggcgaaccttcttctgtttccatgactactccgttttccatcacgccactctttaagtacctcttaatccactggattaccctttcgtccctcacatttctgcgcaggatattcaggagtatctcatggttcagggtatcaaagtatttcgacaagtccaatgctaccgcatggatatatccccgctctgcatactctttcaccttctgaatggcatctttcgcgcttcttcccgggcgataaccgtaactgttctccgagaacaacggctcgtagaccggtgtaaggcgctgtgttatggcttgttggaaaatgcggtcttttacggttggaatacctagctttcgtattccgccgtctggcttgggaatctccactcgtcttaccgggtcgggggtgtactttccccttctgattctctcgataagttctttctggttttccctcaggtatgcgcctatttcctccacggtaatcccgtcgattcctggcgctcccttgtttgcctttactctcttaaaagctctgttgaggttgcccttctccagtatctcctccaagagttccggctgtgcactgtccctttccttccatatccggcggaaagaacggtgcgctctcacatacccttcacgttccgcgctatctctttgcgagcagctatctttgttttctgtacccaatgttctttcctcctttcccagttgtactaaagactcctgttgattcggtccttcatctctcgactactacgacctcggctgacttctgtacgttcagcactatctttcgataatggttatccctttcaggacattccgcacagacctccccgggtaccacacgtctctttctctccatctatctgccacatttaccatacgtgattccgtgtggttattgggcttcgacttgttcagcagccttaccctcacgcatggcctgatgtgatttctgtccgtcagaccagagatttgcccatgggttagtatgttccccacatccggcttccttcagatttcacctcacgatgaacacccttgccttcagctatatccttcccaccaccgggcggattccggactttcaccggttagagacgtgcgccgccgggcgcactgagagaaaggggacgccacagtcacgtgccggtccccttcttaaaaatcttattttgtaccaatacttccggaatctccggctcacagcctgccacgattgatgccgctcccgcgccagaaacagatgctatatcctttttctccaaaaatccgtcagcgttttcctgacatcatccacataggtgcgtccaactggtaagattatattattttcaagcaatagctcattctgtctcatcgtttcaatataatgcatattgaccagataagaacgttctaccattataaagctgtcgtctatccgctgcagaccttcatatacctcctgaagggctcttctttctctgattagttcccctgaatttgtcacgaacacggacatttttgactctttatgacaatacatgatatccttacacggaattttgattcgcttacgcgcagaagtaataaaataatgtttttgattatcagaattaatcttttttaaggcggcttccatgcagtgatcaaagccggcttccaagtcccccttcaccaaataccggaatacatccaattcataaccgacgaccgcatattgatggtatgaggaaatgattataaacagactgtccgaattcatttcccgtattcttttcaggacttcaaggccgttcattcccggcatcttaatatccataaatattatatcataatacctcccactttccagttccgtcaacagctgcatctggctctggtaagcctccacaacagccctgattttattcttttcaatgtatctccgaagcagcttttctatctccctgagcgcctcacggcaatcatcgcaaatggcaattttgtacataccgattcccccttgtatgatatagttcatagcagagatgtctaacctcttctttcagcctgcctatcatccggcaattgtcttcctgatagattctatgctgagtatgtttccggttttattttatcatggacaaataaaaagggctggtgttatgtcatctttctttatctaatatggtataattttagaacttacttccgttcctgattccaacgttgcctaaaaaaagggattcatacggaattatcttatttaaataaattcaatgagtggtgtcaatcattttactggtatcggttttctagttaaatggtgttgaggccaaaaacacatcattaaaaaccaactcaatattaggttttgtggaaatatcaatgctacctataatctttaattcacctctagaaaattcaattaactcaaaatccatccatagctgctcgtttaagtattggttaaaccttcccaaaacttccttaatttcattttctttcattacaattctcctattaagacaccggaatatgagtatttgccgctgcttcagcattatagctcggattttgtggttttaaagtactagtatgataccacactccatctgtacccaaatactcagctccataaccttgtccatttgcatttgtctctaatttctgcaaagaaacacgatatattgaaccttcctttccatattcgattcctttgcgtttttcttactgaaaacttacttgccatgaatttcaaaggtcgaactaataccgatatcggcatttcggaacatgtcttacatgggtggcgcggctacctccagtgttccgtattctgccacccaacgactctaaaactaccgctgaaaatgagaaaactgcagggtgcaaaagtccggattgttatgctggatgcccttgttttttgaatactttttcctgcatttcagaaaaacttatgccacgagcaaaagctgatttcaccaaaaccaacagttttaaggcatttttcagcttctggcaggagattcctttgattcaaccacaatattctgcggattgccagcttctacatgcaaaacagagttggatatcccaattctataccaacaagcggctaccgcccgtcatcttttagcactgtgacggcctgtgtgccggttttaaaccctgctcggaagatgtaccatgaggcaaatattctggcttgttgagccaattcagaggcatttctccccaaatcagccaatatgaccagggtcgaaaagtgtgcaggttaaagaggttatgctggaaaacgcataacctctggggacatcgcccggcaaagccgggcgaatattattctattgtcacttccatttttattccaacagcatcatgtaaagctgtgaggtataaatatttcacttttgttggtcgactatcgcaaataaataaattgattttattatacccaacgaaatttacaaattccataaatattttttttgcaagaacttctgagaaattacgtaattttatatttatacttactacttctttttcatctgcctttatattaaaattttctattccttcccctccttccagaaaggcttgaatatctttactcatccctaactcaatgtgagagctaaacttatcaaaaaaatttaaaaattcattctccatattcacctccaagttttaatttttaggaatataatttcctccgttagtagatgtcggatacgaatataccgtaacgattttatcaccccattcatttgtgattacagtatttccgcgtttgtcttgatatctccaggttactttaccagtaagtttatcaatttcttttgtcctatgcttataattgttatcaattatactatcaaccttctgagaatcaaaacctctttcattcgctctttctgcaccatgttgagtatattcacgaccttttggtgtttcatcgccaggttggatcttagcctcagaatcccccttaccttcctcctccgattcttttttattctcctgagccctcaagatactacctggcggcaataccccagccactgaacccgctgcatctcccggtattgttacctctccgactcccggcagtacaacctgctggcctcctgatgaggagcctccgctttctaatgctcccactatcagcgatagtatttctatcgtaaacattgtttgaccggccgtaaatcctgcgcgaaatgcgtctttattattggatgcatttcttgcctggtcataaatttcctgcaagtcggtatcccaaaaatagtcatcccgcctatacgcatttttgccaaatagaagcgttagctcccagttatggtattccgcctctgctatcttccttcctgcatccattcccgccttatagtcggaacaatatccgataacagatcttcccttttcttccgcggcatccatcaattttttcagctttgtccgggcagtgctgagttttttgtccaattcctcaagcagttctttgttcttactgccgtaatccgggccgctgtcataatcctgaaccggcatcttgttatattcctgccagtttttctttgcctgatccgctgtctctgtccagctttgttttttatgtccactcggatccacataattcggcgcgctcgacttcacataattataccggttcagcgtcagcgggtcggttaacttgccaaggtacgtatcctccgtcaggaaattccctctctccacgtcataataacgcgcccgcaggtactgtacttccagattcggattataatcttccgcattatacgcatagctgttattgtactgcggttttccaaaggtgatatctccggtcggtccgtagcggtaggacttccacagtcttcccccgctgtcggttacgccgcttacgcttcctcttggatcatgggtataatatccggtccagccggtgaaacgttcaagggctatcctctcattaccataagtataagccgtgtccatttccccgtcaatgttcacttccatcagcacctgggcgtattggcggttcacgtcgttcacatattctatcagttcataattcttatggtggccggtctgccggatctcgtcaatcaggctttgctctatgtcggataccggtttctgcggcatcaggattccgctctggttcccgcttcctcccgtgttgttggtgtttccgccgccatttccattgttgccatttccactgttgacatttccactgttgccgttcccgtttcctccgctgtttccaccggattctccttcttcccagccatagtggttgccatttccgccgtttccgttgttgccgttatttccgttatcatttttcttttcggaatttgcggaagcttccgacgggctggctgcctctgtttctgtgtcgtccccgccgtacggtataatcggtagaagctcacgcaccggttccgggcgcatctccagcagcgggacttcggatttcggattttcaccgttttcattagatgcggcatcaggctgcatatctttagccgctgttgttccgtccggttcaccgagcagaagaccgcttaaatctaccgtttcatcactgccggacaggccaatcagccctaatacggaggaaactttctgtttgtttccatttccgctatttccctggctgccgttcccgttgctgccgttattccccttgtttccgctgttccctttgttgccgttcccattattcccgttcccggtattatccttattgtttccatttccgtttccgctgtttcccttccagtcgtcatccgtatgcagattgtagtttaactggaagacacggtttccgtcaccgtcataggccatggccactaccagctcgtgagcgtcgtggacagcttttaaacggttctccaccgtataagtgtaatgaagctctaccttatcggtccccttcttcccaatttcggatatcaggttcccgtcggcgtcatactcatactgcatcgtggtgtttttctttccgtcgtagagtttggcccggatgagctggtttgacgcattatagctgtattcggcgctctcctgcaccgtcccgttacgggtcttggaataggaaatccggttgcccatgtcgtcatatgagtagcggtaaacgtaggttccctgctgttcttctttctcggtggctttgataagcttcccatcgtcgtcgtattcgaagctgcgctttgtctctacgatctggtaattgtcttttgcatctttgtcgtgcttgttgttatggcggtttccgtgggggtatttatcgtcatggcggccgtcctcatgccttccgtcgtgtttgtcgtcccatgcataggcgtagagggattccagcgccgtctctcccacgatgaacccacggtcatcataggtgtaatcgtactggctcaccacccagccgcagtcgtcgcacttgtttaccattgatgtaatctgatcccttgcattaaagctgttataagtgctgactccgttcggccggtgtatctcggtaacccggttgatagcgtcgtagacgtaagtggtcaccccgccgtcccgtcctgttacttttgttatattatcattcttatcatactcgtaggataccgtctttccgtcgggatacgtgatggatgcaagctgatccgctccgtcataggcataagatgtcgtctgtccggaaccgttctttacctgcgtaatccttccgagggagtcgtactcatagctgctctcccccgttgcgtccatcatggtcacacgctgtcccagcgcatcatagccatagcgcacggcctggttctggaagtctcctgctgccgcttcgcttccctccccgccgctctcatagcttttttccacaagcgcattcagccggttgtagtcataccgtatcgtgtcgccgctgttcgtctggaaggaagtggttctgcctcccgcatcataggtcatctgctctctgcgcccttcctcgttcaccagggagagcatgtttccttccagatcgtaggtatattttgtaacacgcttcattgtgtcggtcatggaagttacatttcccatcacgtcgtaggaataccgtgttgtcaggccgctcggcatcgtcactttcaccagcttgtcaagaatgtcatagttaaaacgggtaatcaggccatctgtggaggtgaaggcgagtatgttgccgtgtggatcgtattcatatttctcagtcaggcccatcttgtcggtgacggaagtaatacggctgcccggatcgtagaccgcttccgtcgtctgtcccagcggatcgacggttccggttctgcggttatcggagtcatataccgactggtacagatatcccttcggatctgcgattcccgtcacgttatagtttttatcatactggtagctggtggtccgttctcccggcctggtgacggatttaacccgtccgaccagattgtaggcaatctccgtcgcttttccttccggatccacgctggcggtaagctggtcaacgaggtcatagcggaagttccaggtatatcccagggcgttggtcactgcattctggtttccacggatgtcgtagccgtattcggtcacgcctccttccggatccacggccctcgtcattcggtgcataatgtcgtattcatagctgctgctgcggtcaagactgtctgtatcggtaatgatattgtccgccacatcgtaggtaaactccctcttaagtcccagaggcgtggtgatgccggtcagacggtgtaccggatcgtacgtatatgtgtaggtaccgccgtttttctgcgtcatctttgttaccaggcggtttaaatccacctcgtaccgggtcacattgccggccggatcagtgatgcttaaaagttcatcgtgtttgtcgtaggtatagcctgtttttgcccccttcggtgatatcttctccaccaggttgcccatcacatcgtaccggtactcggttatcagtccattggcgtcctttgacttagtcagattgtcgacggcgtcataacggtattcctccttatttccttccggcgtcgtgtaggagatcaaccgggacaattcgtcgtattcgtaaccggtgacgcctccgcgtccgtccctttccgctatcatccggttgacggcgtcataggtgtaggccctctctgcgccttccgcatccgtggttcccgtcaggttgcccgccgggtcatagacaaaccgtatggctgcgccgaggggatccacctttccggtcaggcggctgatcgcatcataagtgtaggtataaacagcctcccccggttccgtggtcttgatcaggttgccggtcttatcgtattcatagatcgtcgcggtattgtccgccagtgtaatgccggtcaggcggtccagcgtatcgtaggcataacgggtcgtggcaagatccgtccctgtaacggccgtcagacggttaaatcgatcatattcataaaccgcgctccgcccgatggtatccgtctgttttaccaggttgccggatatatcgtactcgtaggtcatggtattgcctgccgtatccgatgcacgggtgatacggcccatggagtcatattcgtaggatgtcacaacgccggcttcatcagtgcttgacgtaacctggttgttagcatcataggtgaaggttaccgtatccccgtccggcagggtaaccgtcagcagatttccattctcatcgtattcgtaaagatatggattccccatcggatcagtcattctgaccgtacggctcagctcatcgtaggtataagcggtctgcccttttaaggcatctgtcatttctttcagattgcccagttcatcataggaatagccggtcacatggccctctgcgtttacgattgccagaagctctcccaggacatcgtagtggtagttgctgctgtgtccgttctggtccgttgtctttaatacattaccgttcaaatcgtaaacgagtgatacggcgcctccgacagcgtcctttatctcctggagccgtcctgccgcatcgtaggcgtaccttgtctcatggccttcttcgttggtccggcctttgaggttcccggccccgtcataggtgtatacagcagttccgccctggggatcttccgtcttaaccaggcggttattacggtcataggtgaaatgatagactctcgtcccgtcatcgcttaccgcaataatatttccgttgccgtcataagtaatctctgtgacaaggccgtttttcgccgtcatgcggattactctgccttcgcggtcgtaggcatatgaaatgccgcttccgtctgcgtaggtaacggcggtcggctgcccgttcttatcgtaggaataggctgtcctgttccccaggctgtccgtggcggattccggaaggttcagtatcgtgttataactccaggaaactgtatttcccctccggtctgtcgaggatgtcaggttgccgttgccgttaaacgtctgcattacggcgcgtcccattgcatcggtaacagcggtgcggcggttccgctcatcataccggtaccatgtctcatttcctttcgcatctgtctccacaatccggttatagttcttatcgtatccgtaggtgagggtatgccctagagcatcttctcccgtcaggatatggtacatcttatcgtaagtaaatacagttttcgcccccgccggatcggtgatggacaatacggcgcccgccgggctgtattcatactcagttgtcccgccgtccttcgccgtctcattgattttccatccattgcggttataggtatagatctctgcgttcccaagcggatccaccatggagagcatacggttcatcctgtcataatcatagcgccagatgtatccttccgcgtccttcatctgcgtgacaaccgccccgtcgtaggaaaattccgtcgtttggccgtttgcgtccgtgacggacaccagacggctcagctcatcataggcatagcgccaggtattcccctccccgcttgtcctcgtcaggagattgcctttttcatcgtatgtaaagaccgttctgttcccctcaaagtcttctgcggccagcggcagattcatcgcattataagcatactccgcccttgctccgtccgctcttgtgacagtcagtatatttccgtccgcgtcataggtataggaggttgtattgccctcctcgtctgtctcctgggcgacgcggccgtcacggtaggtcttcgtacgtgctgctccgtccggatacgtgattttcgtggttctgtaactgccgtcatactcatagcgggtcacaaaaccgcggttgtcggtcagtaccgtcgctccgtctgaataggaaagatacgaagtatttccgtttgcgtccgtctgggccgtaatccggttctcactgtcgtattcattttccaccacgcggttcccttcctcgtcgtaccaggccgtcatccggtgtttctcatcgtattcataacggcgtatatctccctccggattggtgacgctgatcagattgccttcctcatcgtattcgtaacggagggtattgccgtcaggcagcgtaatgtccgtgatgcggtacgcgtcatccattgtgatatcaagtatcctgcctgtgggagactctgcctggagaagcttataatcctcgtcgtaccggtaccaggttctgcgtcccttcatatcctcccggtactggagaagtcctaacgcgtcaaatacatagcggctgccgtcctggttcgtaagctgccatccggcgcagtccgggattggcgtccgctctgcctccgaggaggtcgctttcaggaaaccaaagcggatctcacccctccggcggttcagctgtgccttatcatccagatcttttgtggttacgatgcgtgtccccgcttccctctcttttggctcctcttcttctgcctcggatgcagacgcccttcgcacttctatggcatcaagaggctcaagagtaatatcccagccgtcgggagcctggtacacatccccgttcctggtaaatgggattccctttccatcgcttctcttatagagaatggttccatcctttaatatagtcaggtggtcgccgaattccgatgtccatccatagccaaattcctggtggtaatccgggagcgtggagttatagctcctcatgactccgaattctccattcaattctttcatggatgcatcggtctgctgcatgaagaagtctccggtattcatattgaccggttccaggttcagttcgcagttcggatttatgcctgccagaaggttgcgcagaagcagttcttccaacggcgtcatatccttatacgcattataaggctccgccgtcttagggtttctgataaataaaatggtatctttctcagtcaattgatccttatataatttattatcacgcgcaagctggcctacattaatgccatagtggcgggcaatcctggtactcaaatcatgctccttcacctcataaagcagaaactgatccgatgtaaccgttgctcctacaaccgtattatctccgtccggctcctcctcaccggaaccgtcttctccgacttcttttcctgtggcaaaggcttcaaaatagtaaatggtgtcatattccaggctgccttccgcttcaaacccgtccgtctgccagtttgattcaggagacaaatcgaagtcatcttccagtccggccttccgaaaatcaggatatacaagtgattccattgcgtccgttacgtcgccgccgccttcctccagaagccggtaggtgacctccgaaccggcctgcgccttaccgtgggcgatcacgccggttacgctgcgtccgaatatatctgtgtagattacggccggatccacttctatcgtcgtgtcatccacgctcatattggcaagatcgccttccagatcgcctgtccatgaatattccagccgggggccgttaaccgaatcccctctgttgcacagcacttccgccttcatggcatacgcgccgccgtccgcctcaatttccgaccggaacatcagtcccaatggcggctctgtcacggtgatccatccgttgaccagatccgtgatgtcaaattccatcgtctgccctgcgccgggcgccggagtctgccagactctgtctgaacttggattatagtccggctgggtgttccagcttgtaatataaccgttccattgagtgacaggcacatgcagctcgattatattctgaccgccgctgttatccgtctctgtcgtgaccttcagggtcgcattgtgaacctgctccgctcccgacagaagctttgatatggtatctgaattattttcattaaaaatcacacatacccggcagttcttccggctgccgtccagatatccgacataggccgggctgtcccaatcataaatcgtgtctggctgtccctgtgatatcgtcgcaaaaataaattcatccgagggaacgtaggtatccggatcaatgcgtaccggataggaccgctcttcatcattcagccacttcttatctgccttaatggtgactgtataattccccttcgttccggaaagtttcagtttgaccttatcacttctctcgccggaatcatcctccatgaacggagcgtccaactgaaacagggctttcgccgtgtccttcccgtaaatggaaattttatctttttcctgcttcgcagtcattcccggtatcttgagtttataggagaactcatacctgtcccccttctccagaagaaagatatcacctttcaccgtattctcaatgactgtatactggtaatctacattctcaaatacatcattaaaccggattgcatttccggccaccgacggctctttaaagtttccggcagacggaatcagttcaatctttccgccttccgtctctatggaaacgccccggctggtactcatcttaagcggaatccgtatctttacaggaccggcttcattttccacccatgaggcagccttgctccgcaagaaagaggcgttggacggtgtcgcttcttccccgtctgcttcgacagcggcagaatcgcctttgaccagagtattgtcaatcggccgtactttaccgtccttgtcacggtacaggccggaatatccgccaattacggttacgtattccctgtccccggtctggtatgtgcggcagagatcggaaaactgtaccagcacgccggacggctcttcagtcacctcctgataaagctcttcaggaaggcgcagtccttcatccgtcaccggtatctcaccgggtatctcttcttttgcatcctcttccggtaatccttcggccggacctgccgccggattatcggccggatcacctccatcggccgaacctcccggctttgtctccgctccgttctccgaaccggctccgctgtcctgtgcaggctcatcttccttcccgggttcactgtcttttccaggctcgtcttccttcccagcttcgctgtcctttccaggctcgtcttctttcccggcttcactgtcctgtccaggctcgtcttccttcccggcttcgctgtcctgtccaggctcgtcttccttcccggttccgctgtcctttccaggctcgtcttccttcccggcttcgttgtcctgtccaggctcgtcttccttcccggttccgctgtcctgtccagactcgtcttcctttccgggttcactgtctcttccaggctcatcttccttcccggttccgctgtcctgtccggtttcattatcttttccaggctcgctgcttttaccggattcactgtcttttccagtgtcactgtctttatccggttccgcactattttctgtcctatctgcgcggtcaccatcagaggtatcggacactccggattcaatccctaattccctcagcgtcagggcctgaggccttgtaaagtccacataacgcggctgattctctatcagctccgccgcctgcgctataatcggcgtcatgtttggcgccagcatggcggttataagaagaccgctgataaattgtctggccttttgacggtaacgttttttcacttttcttttgttttctttcatacttttttcctcctggtaaatattatcgttactgcttacacaactgaattctctgtcttcgccggggcgctgaagctgcctgattccctgatgccgcatttgcttgcatatctattaaaaactcataatttgagtatttttactcttgttaatagtatttaaatttaagactctgcgcctattttatctgttaacttgctaataattttatcatatatctcatttcttttctcatttatgtcccttaattgcagcttttagtcctccaacagttttgtccgcaatgtaaaaaaagtacacaaaaagcggcagccgcccggatcccgtcaggatcccaggcagctgccgccctacatctgtacttccattttattctacagccattgactgtttttctttgtaatgatgagcttcttcaagcatcatatccttcaccttcatcaggcggatctgggtgcttctctcgttctcatccagcttcatcgtgatatacttgatattcttcttcgtctccggaatgattacatgctccagggcgtttacacgcctcctggtcttctcaatctcggcagccataagctggcaggccttctccgtctccgacagcttcagcatatccggcagaatgtctgccagggacttaaccgcgccgtccaaatcgccggaggtaaatgcaaatccataggaataaatatcattctcatccgcagtcctagtcttatattcaaaaaccgggatatcgacactcatgacattcttctttcccgtttccagatatacctcctgcttcggtgcaatcagcgccgcattcagcgcctgctcggacattcccgccttcgcaatgacgaagttcttattggcgctgcggattccttcttccaccttcagacgcagggccatgttctccctcgccagatccaggaactgccgcatcagctcatcccgcttatctttcagaagcttatggcctcttgtggccgtcaccagttttttcttgagccttgtcagctccattctggtcgggttcacctgtgttgatgccacggcaatcacctcttttcattatttcccgtaataaagatccagatatttgtcgtcgatacgtttcagctctgccctgggcagaatggaaagaagcttccagccgattttcagtgtctcttctatatcgcggtttgcctcatacccctgggaaacgtattctttctcaaaggcatccgcaaatttagcataaatcaggtcgatatcggacagcgccgcctcacccaggattaccatcagctcttttgcctctttacctcttgcgtatgcggcaaacagctggttcatcgtattggagtgatcggctctcgtcttgccttcgccgatacctttatccttcagacgcgacagggaaggaagtacgtcgattggcggcgtaatgccttttctgtaaagctcacggctcaggataatctggccctccgtgatatatccggtaaggtcagggatcgggtgggtcttgtcatcctccggcatggtcaggatcgggatcatcgtaatggaacctgatttgcccttctggcgtcctgctctctcatagagggaggcaagatcggtgtacatgtagccgggatatccacggcgtccgggaacctctttacgggctgcggaaacctcacgcagagcgtctgcatagttggtgatatcggtcaggattacgagtacgtgcatgtctttctcaaaagccaggtactcggcggccgtcagcgccatacgcggcgtcgcgatacgctctacggcagggtcgttagccaggttgacgaaaagcacggttctgtcaattgcccccgtctctttaaagctttcgataaagaagttggattcctcgaaggtgatacccatggcggcaaatactacggcgaaattttcgtcggtgccgcggaccctggcctgccttgcgatctgtgccgccaggttggcatggggaaggccggatgccgagaagataggcagcttctggccgcggaccagggtgttcagtccgtcaatggccgagataccggtctggataaattcctccgggtaacttctggccgccgggttcatcggcaggccgttaatatctcttctctcgtccggaagaatctcaggaccgccgtcaatcggccggcccagaccgtcgaatacacggcccagcatgtcttccgaaacgcccagctccatcgttcttccgaggaagcggactttactgtttgaaaggttgataccggttgagttctcaaacaactggacaagggcgtcgctgccgttgatctcaaggaccttgcaccgcctcgtctctccgctggccagctctatctctcccagttcatcatacgttacattctcaacgccgcgcaccagcatcagaggaccggctacttcctgtatggttctgtactcttttggcatttagaagtcctcctttcctaatacatcggcaatttcttttgcaagctgctccaaaaccgcctgatattctgtctctatcttatcttccgtcgtatatttgaaacggccgatccgctccctgaccgccattttaatcagcccgcccgacgaagctccgtcattcagcgctttctgggattcctcatagaaagccagaaccagcttcatcatcaggaactgtttgcgcagggaggtataggtgtcaatctcatggaacgagttctggtgcaggaaatcctcacggatggagcgggcagcttccatcttcagcctgtcggaaggtgaaagtgcgtccataccgaccatcttaacaatctcatccagctccgattcctcctgcagcaggctcatcatcttctggcggctctgcatccactcatcggcaacatgctcgtcaaaccatttgcccatgctgtccacatacagggagtagctggtcagccagttgatggccgggaaatgacgttttgccgccagggaggaatccagtccccagaatacctttacgatacggagtgtggcctgggacaccggctcggagatatcgccgccgggaggggatacggctccgattgcggacagggcgccttccctgccgtctttgccgagacaaaccacatgaccggcacgctcatagaactgagccagacggcttcccagataagcgggataaccttcctcaccgggcatctcctccagacgtccggacatctcacggagcgcctcggcccacctggatgtggagtccgccatcagggccaccgaataacccatatcacggaaatactctgcaatcgtgatacctgtataaattgatgcctcacgtgccgcaaccggcatatcggaggtatttgcaatcaggacggtacgctccatcagcgagtatcccgtctttggatctttcagttccgggaactcatttaaaacgtcggtcatctcgttcccacgctcaccgcagccgatataaacgacgatatccgcctccgcccattttgcaagctggtgctggataacggttttaccgcttccgaaggggcccggcacggcggccacaccgcccttggcaatcgggaagaaggaatccacaaccctctggccggtcacaagcggagtctccggaggcagttttttgagatatggacggcctttgcggaccggccatttctgcatcatcgtaagctccctgtcgccttcctgggtggcgatgacagccactgcttcctcaacggtgaattcaccgcctttaatctcttttaccgtacctttgacgccgtagggaaccataattttctggactacgactacggtttcctggacggttccgaggatatcgccggcctccacctcgtcgccggcctgtacggcgggaacaaactcccattttttatcacgtttcagggacggaacctcaacccccctcttcaggttgttgcttccggtcgccttcatgatatcatccagcggtctctggatcccgtcataaatactggcgatcaggccaggcccgagttccaccgacagcggaacctccatcgattccaccggttcccccggtccgagtccggaggtctcctcatatacctgaacggaggcttcgtctccgtgcatctcaattatctcaccgatcagacgctggctgcttacacggaccacgtcgaacatgttggcatctctcatcccctgtgcaattaccagggggcctgccacttttttaatcgtacctttgctcattggaaggtcacacccacctttcttaacctataatggttccttactggttccctccgaagaggatatcagaaccgaccgcctgctctaccgattttttcacaccttccacgccttttcccgtattgccggagatacccggtatcaggatgatggaaggaagcaggctttctttatatttcgctatggcgcggccggtctgggccgccacagcctctgttatatagatgactgcatattcactgcctgcaagcttctgaagcgttttctcagcatcctcctggccggatactgaaaatgtatccagcccgagcgccgcaaagccgtaaatactgtcgtagtcgcccatcactgctgctttatacatacatttcccttatcctttcccggatctgctcctcaggaagctcattcagcctggccgtcagaataattctgaccgtcttaatctcattttctctcgccagtacataagcgaccagcggacctgctgaaaacggattgtacttctgcggcttaattgcctccatcaactggttgtcacaccagcgttcaaaggccgacggtgattcccgaagcgcctcggcgccgcctgcatacgcagtaccttccagatattcgcagatagcatccatgccggacagagccgccgaacttaaccgttccacgctcagactggcacagggagccatcgcccgtttaataaattccagtgattttgcggttttctgtgaacggacggcaatcttgatatcggcaaccgctacggttgattccgcgtacgccctgattaccgggtccgcggctttttccccctccgcataaattgcttccagcgccgccctgtctacgatgatatcgcagagctgtccgtcccttgtgtgcaggaatgtctcgtaggcttcctccgcagccgccctcatattggccgggagcgcctgccagtcgcgttccgcaacaatccgggccatctctttgccgccaattgcgcagttatcaaaatagatgttcccgtgatgatcggaagtgaccgtttccttgattgccgccttcaggttgtggaagagattttcgtaggacaggacattgataatccccgcatcctctttttttaaaaggtctctgaccacattccatgttttttccttctccctggtcaggatcgcttccgcgtccattcccgtgtcctggtccccccagcccttctctgtcagaaactgaagacagctctcatacgtcttcagggccataagctgatccagtgtggaggaggaaaacaaagacagttccatcgcacggattcgtgcaaccgcataggcatattttgtatcagacatataatcctccttgtcggttacaccttatgaaaataacattgcatgtaccttatcggaaagttcatccctcctggccgcaagcagcgcccggaatgaacagttttcctcgattcccccatagacaaggataaaaccgccgtctatgttcttcggctcttttacaagagtcaggcttccgccctttgaaacagccgctttctcaattacggcctcaaatccctgcggcatcctgtccaggtctttttctgaaaaataaatctcgcccgtcttgggcaggacatatttatcaagcatttttccaatcagggcaaaatactcttcgccctccttcttaagcagcgcctcgtatgcctgttccagcatctctgtaattacctgctgctttgcaagaagtacggcctggcgttttttaagctctgcggaggatttgatgcgttccatatagcttgtggcctctccggccagcttctcatcattctctgccgctatctttttacagcccgcttttgcctcggccagaaccgcctcagcttcgctttttgccttctcggaaatctcctgagcttctttgcctgcatcttcaaggatttgacttatgattttgtctaatccggtcattccaaattctccttaaatttaatggttatcaatgtggctgaactgataggtcaatgattacagggcgcttactgccaggatggagattaacagcgcaagaattgcgtatgtctcaaccatggccgggaacagcatcgctttaccgaactgatccggtttctttgccacgatgccaatggaagctgccgctgtctcgccctgatatcttgcggagataagtcccacaataccaatcggaatacaggccgcaaagtaaagaaggccctgagtcatgctcatatccatgttaacgcctccgcctaaaagaccgattttagacagtgtgatgaaaccaaccagaagtccgtagataccctgtgtacccggaagaagctgaagcacaagaaccttcgcaaatttaccgggatcctccgttacaacgcctgccgccgcctggcctgcaataccaacgccccaggcagaacccataccggccagaccaactgctaccgctacacctaataatgcaaaaactataccgctcatattataaatcctccttgatatctacatatttcgtattttgtttaaatggcgagaattctcttcctccgccctcatagaacttaccgaaaaattccacgtactggagacggcatgtatggacatacgcgcccagcaggttgattgccaggttgaacagatggccaaagcagaaaatgataatgaataaaacagcgccgacggggcctcccccgaacatgctgcccatctggttcactaccgaggcgataacgcctgtcgccagtcccagcgccagcagacgcgaataggaaagcacgtctgacagccagccggatatattgtacaaatcataagcgccgagcgccagcctgagcaccgggttcttcgtggttctggccgacatgcacagaattccgaccgcaccgatgattgccatccattttgccagcatggagacagcgggcgggaatacaatctgtacctgcgcgatagaaccgaacagctctgtcggaagcagaatcagcaccaggccaatcagcatcatgtaccacagcaccacgtcacagacaaagccgagggtgtctttattcttcagatacatatatcccttgatgcctaagccaaggaacagatggataactccgaatatcatggagcatatcagcatcttcatcgggtcgtttaacggtacgaaccaaagcgccgggatcgaaacctcgcggccaaagaaggttttgctgataatatttaccgcatctccgaaataacctccgaacagcacgccccagaacagagtggaaagtccgcagtacataaacagccgcagcgactttttcaggttttctcccattctcgggaacttctttatagcgataaagcaggccaggaatacaatcagaccgtacgctgcgtctgaaagcatcaggccgaacaggaatacgtagcaggccgacataatcgtcgtcggatcaatctctcctttggccggaagaccgaaggaggcggtaatcccatctgctgcggaagcaaaatggccgttggacaaaagcaccggagcctcttcatcctccgggacgtcctccgtctcaaaggacaggtcgaaacgtgacgtgagactctcctccagctttttcacactccgtttcggcacatagcccgtaacgataaatgtcttttctgactgaaccacctgtcccagtacctcatatttctgagccctgatacggtaataatcagacagaagtttcaggttctctctgcttccctcatataccttcagtttattaatcgtattttcaatatctttattcagtttttcaatctgtgcccgcagctcttccacatactgcgcgggaacctctccgaccgtttgggacggccttgcgaatcctgccgctctcagagcatcctcaagctgttccgcatcccttttcaggcagatggccgctatacaggtttgatccttgtcagctcctaccacctggatatccaggttctgaagctccggcgccttttccgcgaccgccagataaagctgctccagcgtcgcaccgccggctacggctcctaccagaacagaagtgctccgtgtctcctgacatcccagcgggatatccagccccagccatggcgtcatgccttctatctgtgtttccagcttggctatgcccgctttctgctccgcgacctgcttattcagtgtctgaatctgccttgcgtcctccaggaccgtctgggcattatcggcgacttttccgaatttctcacggtctgtcagagcctttccctccagcgcggaaaacatgccgctcttctcaggaacatattcctgcagtatctcaagagcctgatccgcaagggccgcattcctgtcaaacatctgccttgaagaaacggtatccgtcttcctgaatacaccgtcctcctccgcttcctgagtgacctccaccacgccggcagcctgcaaaagttccagaacctctttacggttctttttcagtgcacagatactaaatttctgcatctgcaatactgccatgtccgcatccctcctaacattctgtcattgcgccgttaaatcagctcggaaataaccttattgattacttcctccgtcttctttccggcattccatttcagggaagcgatatcttcctcggccgcagcaaccgccttttccagataatctgcgccttcctctgccagtttctcccggatctttccggccttctccctggcttccccgagggcttcctcacgcatctttgatgcttcgctctttgcctgattaaccagggccttcccttcatcagacgctttttgaatcatctcagcagccctctcctctgcttcttttacggcctggatcgtgtccttgaccatctcctcaccaccttagcttctgatattttcgaaaaaaaatcaccatctttcggagtcattccgatgatggttcaacatgtgcggctccccaatgaaacgtctttcatttatctgttttattatagttcaagcctgctttttccattcatgaaaccgcataaaactcttctctccccgcacatttgtatactattataactatttacttcagacttgtctattaaatgttatagaattgataaaattcatacaattcttttctaataggtgacattttgtctaaatctgtatatttatcctcattatcgctttacaaagataaagtcctaaaacagcggtgacctgcatgctccgcgcacagggtaccgccatcaatataaagcgcaaaaatgcaggtttccgctggctttcagcctatggaaacctgcattttgcattctcttttaccgccccgttgttatacagaaacatcgccaccgccatcgcgcagataatcccataccctgcaaagctccacttatccggaatctgcccaaaggcgaagaaaccgagtatcgtggaaaatattatctgcgagtaatcatagactgagattcgtccggccggagcataacagtaggcggcagtgattgcaaactgtcctcccgctgccgccatcccggcaagaagcaggattaccgtctgcgccgccgtcatcgcttcatagtgaagcagcagccacggcagtattacaatgcaggaaaacgccgagaaaaaaaagacgataaacgggcctttttccccgctctcccccagcttcctgaccatcgtataggccaggcccgcacagattccccctgccagtccgatcagggacggaataaatgccagattgaggaaggtcggctttacgacaaacatgctgccgaaaaatgcacccaggatgataaagacctgtgcaggagccaccttctcttttaagataaggaaactgaacaggactgcaaaaaacggggacattttattcagcatggatgcgtccgccagcacgagatgatcgaccgcataaaagttacataaaattcccagcgtgccgaacagggaacgaagaaaaaagtatcccgcattgcttctcttctgccatcggaacccgccttccccgcgaatcagaagaatcccggcgaaaaccaccgccaccaggtttctgaaaaagcttttctggatcgaaggcagatctcctgccatacggacaaacatattcatcacggcaaagcagaatgccgacaggacgatataaaaaatgcctttatattcgttcttaatgttcataattttatcaacatttcctctctttcttcattcgattatccccaaaacatcctttattataatggcaagtccacaataattcaacatcatcattattttggggcagaaaaggagctgctgctccagtacattatttatctactgttgcagcagcccctgttactttctccctggtccgtatgtgcaatcagaacagcaccatacagcttaataccgacacggcggcatatcccgccgcaccctccagtataaaattaaagagtaccatatttccccccggtgccgttaccagaaaggaccggacggctgattaagttacagccatactcccgttccaacaccgaccggaagattcagcaccacccacagtacaatctgtacgacaaagatgaggaataatccaatcgtatagggcagcatattggagtcaggttgatgcccccctatagatgcatgttctttctttttgcacctttactgcatttttttacagagcggccgattaacttcacgtgaaccaataacatttttaataatggaaattggaaatcaactatttttcatttaaaaatcaatattattaatattttaattaaatatattaattttatcattgacatttacaatttttaggactatattacttgtatagagaaaggaagtgacaagatgaaaaaagtcatcagccgttgcccggtctgtaataatgagcttaccgttgcaagacttaaatgtgattcgtgtgataccgtaattgagaataatttcaggctcagcaaattcgattatctctcagatgaagaactgtacttcacagagacatttatccgctgccggggtaatatcaaagaggtggaaaaagaactcggcatctcctatcccacagtgcgttccaagctggacgcggtaatcaagaagctcggatacgaagcagggacggatgaccgggccgttaagaaagaagagattctgaaagctcttgaaaacggggaaatgacggtggaacaggcaattgaacagttaaaataaacgatgcatagagaaggagaatcattatggatgagcaattaagaatattaaaaatgatagaagaagggaccattaccgcagagcagggcgccgaactgatgtcggccatgaacacggacccacaggagctgcagacagcggcacccaaaagcagaagcagctatgataagaagatgttccgtatcctggtaagcagcacgtcaggcgacaaggtgaagatccagttcccggtaggcgccattaaaaaaatccttaaagtgacggggaagctccctatacctgaaaaagatttaaagggtatcgatctcaccagtatgatggatgcagtttcagaatgcctggacggtgagattgaaggtgattttgtcaatgtggaggccgcggacggaacgaatgtccgcatcttcgtagacaaatagaggttagagagcctcatatttgaaaccgaagaaagtcagatttgtctgcggaggctcctcctgagcgctgttaaaaacaatatttttctccctgacggcagaacagccggtcactgctccggccatcagggaaatcagcaggcccttcgcaatcatctgctttatattcatactctttcctcactttttgcttttactttttcatccaacgctcctggattttcttcttcaaatgcatcagggagccgttatcaatcacctggcagaaccggaagcaggtcaagccatgctcttcacaatactgctgtatctttatcggaagcccttccatataatccgaatcctgcggcagtatgaccactgtgttttcatccgcctgctccagataagaaagagcctcccctgcccggacatactcccccctgcctttcatcgccaattccctcagatagcgtttcatactgtaaaggtaccattcatcctgataaatgaggactgccgtctgtcttttatctatcttagccacctggctgatcgacagcctgccgggagacatcacaaccatctccacctcaaacggaagctctcctcctgtttttttcttgaccagccgttttacatcgtccacatggttgatcgttgtaacaaccatgtcgaagtttccatccgtcagtattccggcatcctcacgcacatcgtcaagcagaaccggggccacgcccgcattacagaaatctgccagctcctcagcgcaggctttcaggatttcttcactgcagtccacccatgccacgcggaccttttcccgctccggcagacagctccagatacgctcgagaaacagattttcaatctcatgccaggtcagaccggaactgttcagctcatagacggcctcccgcagtaatttctccactctttttttctcacccgataaatcaggtcgggacgcatagctgccgctcccctgaaccgtctttataaatccacgctcttccaggtccgcgtatgcccgcttcaccgtatctctggatactcccaattcccgggacagccgccgctccgcagggagccgctccccctctttaatcccgccgctttcgatcctccctgcaatctgctccgctatcctgctgtaaacgggacatcccggaggaaattttgtctcaggcatttatatctcctcccctttcttcctcctgaaggttttcaaaaacctgttttaaatggagcaaagaccctttgtctatctcaaattcaaacggaacaacgggacatcccattttttcgcccggctgatgagctggagagccagattactgctgtaatccatatagtcgggaggaattataaaggacagcggctcctttgtcaggcgctcctgttcaaggccgatctgctgttcatttacgcagagcagccgccccttcttgcccagaaccttcattgtatactgaaccgactccagaaattcccgggagcggtacagaatgcagatatcctgccaatccggcagtaccgtcagctttgcgattgttttcctgctctccctcagcgccactttctcagtccacaggtgcatggaatctgcgtaccggataaaatcattatagtgcttctccgccacgagtgtaagcgcacaccggggacttatcatactctctccgctaaacagactgttcagcaggtaaggttctacctccagccccgttttcttcttcagatcaagcattatatggtgcagtgtctccgaattgcagtcaacaagggccacctttaccgttctgtcgcttccgaatacagactccatctgtttgcgcagcatcaggaaaatccggttcatcggaattcctgttttcatcagcgcatccacagtctgctccaccgtttcctgcggcgttctttctgactccgcggtcttttctccctgcacataggagcctccgccccgtactttgcagatacatccccgtttcttaagaatatcatacgccttcttaaccgttccgaccgatactccctgttccccggccaacagcgcttccgaaggcagcctgtctccgggcttcagctccccgcgttcaattttcccatataaatcctcagaaatccgcctgtacagagcagaatttccggttttcccggactcattcttcatagccgccggctcctctcacgattccgttaatacatattatccgatatatcccattcccgtaaagaaaaatacccacaaaaagatagtaaacaccgatgccgccgtactcaatactacaaactggcccgccagctctccgtcaccgcccatattctgggccatcgaataagatgccgtggcaaccggcgtcgcatacatctcaaacagaataaagcgttccaggttattaaagccaatcatagtggcaatcacggtgataaccgcaggcagcaccagcagcttcactgccatcgaaggcacaatatattttaaattatggctgattgcggaaaaatgcagagtgcctcccaatacaaagagagccaggggcgtggtcagagcggcgaactggctgatcggggtctccacgctggatggcagtttaatgttcagaacataaaagattaatcccaccagcgccccgagaatcagcggattggtacagacattcttcaccagcgccatcggatttgtcctgccgccgtgaaacatctccagaataataacagccgtggcgttataaaccggtattacgatggctaccatcatagatgcaagaacagcgccctcgtcaccgaaaaggttcgcggtcagaggaatgccgaacaaaacgaaattgctccggtaaattgcctggataattacacccctctttgcattttcgcttaccatgcggggaatcgtaatgatcagcagagcctgcagaattaaaacgctcagaactgccgtaaccgccggcttccaatttaacacaaggccatgatccaccttgtacaggttgttgaacataaggattggaaaaaacgccttgaaaatcagtttattcagcctgttcataaaatcttcatcggccaggccgcacagcctcaccccatatccgaacacaatataaattaaaaacggcattaccgcgttaactgcaatgataaaacttctcattctgatcccctgttccatttgttatttttttatttattttttctgttcttaccattataaggttatcgaaggagcggtgcaataacatctttactctaaattgatataaagttatttaaaaacggaaacgatacgcgataacctgcacgctccgcgcacaggccccgtcatcaataaaatgcggacgttcgcaccgggtatgatatctcattccggtacagacgtccgtttttatcctatatccttattgcttttgttccggcttatttaattgcgccgatttccttataatatctggccgcgccgtcatgaagaggaagatctgcaatgtccttcaccgcatcctctgccttaagtcccttcagcacggaattgctctctgccattttgtctacattttcccaaaatgtttttgtcaaatcatataccgtatcctcgtcgagctccgccgttgtaaacatcaccatcttgattgcggtcgtctgaatatcggaatcctgaccggagtacgtacctgccggaatagtgaactttgcataccacggatactgatcctgcagctttgcaatcacctcatcatcaatgctcagaatcttagcatttgccgtagatgccgcctccgtcacggcggagttgcccagtcctgccataatccaggcgccgtcgagctgcttattgcgcatcatatccacagcctctgtaaagccgatattttcaatcttgatatcatccggataagtcaagcctgctgctgtaaaatgatttctggactctccctctgttgagcttcccaccgcaccgctggcaaaatgttttccttttacgtcggcaagcgtgttaatctgtgagtcggcagttaccacaacctgattcggattatagtagagtccggcaatcacacggaaattttcattcttacgtccgtcaaatgttcctgttcccgtataggattcatagcaattgctgctgatcgcaatacttacctgagcttctttatccgccagcagattcaggttatccacaccgcctccggatgcctgggaggtagcctttacatagccaagctgcgtattccagacattggtgatagccgcgccaagcggatagagagcgcctgtggtggctgccgtaggaaaattaatattgacagtttccctggcacttccttcctgtcccgcatcttccttctgtccggcgtcttctccctgtgcgctctggctttccggcgctttggcactgctgccgctgcctgaggaacagccggtcagagccgctgcggtcactgccgcacataatcccattacaactaattttttcattgactttttcatttcttttccctctttcatttattaaatgtgtttaaaatgcttagattatatattgtggagctactgcgcctttaccgcaggcgcctcttccccgcccttctttaccttcattctctgataaatgaaaactccggcaaaaaggccgattccaatcacatctgtcaccatattagggtcaatactcaggaatgccactactaataacaccgctctttcagcccagccgcatctgcaaaacagcattccctgaagaccggaggccagagccacaacacccaggcaggctgtcagcgtcgcctgaactgtcgtcaggacggttgcatccgtcacgccaatcagaagtaccggatttcccaggaaaaagaatggcaggataaatccggtcagcccaagcttgaccgcaagcagggaggtcttcgtctgattggaatccgctatgccggccgccacgtaggaactcatcgccaccggcggagtaatattggacaggcaggcatatatcagacagaacatatgagccgcaatgggcactgccccaatctctatcaggaccggaatcgccactgccaccacgattacataggcagccacacccggcacacccatccccaggatgatgctcatgatcataaccatgaggccgcccaggtagagctggttttcaccgaccacttcgagaatcagatatcctatcgtaagtcccaggccggtcagggaaaccgtaccgattatcactccgatcaccacacaggatactccgacactgacagcgcctctggagccctccaccgctgcatccacgatatccttaaagctcatcctcgtttccttgcggagccaggaggccagtatagtggcaaatatggagaacaccgcagcatagagaggtgtataccccagtacaatcattccaatcaggactaccagaggaattacaagatgcccctggtttttgagtacttccacggcattcggaatgttttccggagccagcccctttagtcccagacgttttgcctcaaagtggacggccagcagcagacccatataatataggaatgcagggatacaggctgctatcattaccttgctgtagctgatccccaggaactccgccatgacaaatccgactgctcccatgataggaggcgcaaactgtcctcccgtagaggcaaccgcctcgaccgccgccgcaaactccttcctgtagccggtcttcttcatcagaggaatcgtgattgttccggtcgtcgccacatttgcaatagcgcttccgttaatcattcccaaaagggcgcttgcgagtacggctacctttgccggccctccgggagaacggcctaccagagtcagggacaaatcattaataaatttgctgaatccactgtattttaaaaatgatccgaacaatacaaacaggaatatgtaggtcgcacttacgccaatcccgacgccgaagatcccctggctgccccagaccatatggctcaggacacgtttcatcgaaaaacccgtgtgccccaatggtcccggtatatattttccgaaaaaattatatgccagaaagataagtcccagcaccgcaaggctcggacaggcccgcctggctgcttcaaacacgacaagcattgccagcgcggctatcacaatttcccgtttcgtcagataaccgcccgactgggcaatccgggaataattaagcagcatgtagccaaaggcccctatagccagagcaatcagaagcacgtcccaaaccggcggggcatttctcaccttcttctcttttttcaccgtgggatacagcaggaacgtaaataccagaaggaacatgcagtgccatatacgaagatccatggaactcatgacgcctatcgtatttacatagatttggaataccgcccaaaatgtaagcagaaccgttaataatatcccgaaaaaaccgttgtaagaacgcgtcctcgcgtcggcatccttctcctccagcaggcgtctggcagtttcccccgctgctgttgtctcatcagaagacaggggaagacggtttttttgattatcttcagacattgtaattcctcctttaacgcgtcaaattattgaagttttcaacagtgtcttattataacagaaatatggggcacagtaaaggttttatggggaaatttcttaagatatggtaacagttcagccatgatgtattccgcgaggtgttttcgctgttttttgcgaaaatcccgagttgtgcggcgcgaaacggcgtttttttgccgtttctgtgcatcatttgttacggtttagccaaaggctgaactgtaacaagatatggggatttaactgaacaggcgaggacgttgccgggacggccagcggccgctgattgtctcacgcgttaagtgcgggggcggaccttgtcacggccactcaacgcattgctatatttgatgtttatattagattgagcgtattagattgagcggaattaagaccggaagaatatcaccggttttaattccgctcaatttggtgtggttgatgtaatttcagtataatttttaattgaagaattaccatgctgcccatactatttttatcagtattatgtagtggcagcgacaaggtttcctccccattgaggctggagacaatcagcgtccggaacggaccggggccgcgaaaaccttctcagggtcttccgtccccggcgataacctgaaccggggaagtaggcggaatcaattgcggaggggacatgggagtccgccggtgcttagcgaggtcccttacgagcttagcactgctgcgcactccaaagagtgaaaacggtccccgcagcaattcattccggccggatttcccctccacgatcaacctctcacggggacggaagactcagaaaaactacccttaccgcaccggccccggtccgatccggacgcgtcctccatttttaactaaacctttcttgccaggctgtatacatcgggtcggcggttctccaaagtgaaaatctgcctgcggacctgggcaagatagtccagatcaatttccgcggtaataacctgcggccggttggaggcgcgggcaattacattcccccagggatcgatgacaacagaattggcatatgcctggaaattcggtttcacgccatactgggccggagctatgacgtagcatccgttttctattgcacgggtgcgcaggatggtctcccagtgatctttgccggtcggcatcgtgaaatctgccggtgtcagcagaagctgggcgccttccagagccatgatccggtacatctccgcaaaacggatatcatagcagatcgacaatcccaggcatccgacttcccctgtatccaccgtaacaatctcactccccggacagatacggtctgattctttgttcaccggcccgtccggaattatcacgtcgaaggggtgtattttatggtatttggccgccaattctccctccgggctgataaccatggttgcattataaggtctgggatccttttcattcttctcatagatactcccgcagtgcagccatacatggtgttttttcgcctgctccgccatcaggcaaaaggtcgggccgtccggtatattttccgcgtgtcccgcattatccgtccccacataattcatgctttccggcattgcaatcagctttgcccccctggcggctgcctccccgataaattcgacggctgtctgcagatttttttccacattgtcctgggaatccatttggattactcccacggtaaatttcttcatatgattttatctcctctcaaggttatttctaaaactgtgtcgcgaagcggggcgtgcagatggctggaatgaatttttagacacgctctaggcccgcttcttacgtccgtataaaagctctccgccgatccagaagaacagcagcagaattacggaaacaatcgtggtaggaacaggcgcggtaaaaattgccagggaaccgaccaccatatagggtatctgccatgcataacccagggtgctggatgtggaaatacattgtgccgccgtcgtttcattatacggatccataaccttgaccagcatcagtccggtagccaggactccgcagcactggccaaaaaggcccactccggtttcaaaccagttggcttccagccagcgcctgccaagtacaaagcttccgtacaggtttgccagaaccatcgcaatggagacggcaattaatggcagagcataggtaataaaaatctgtttggaggtggttgcaatcgcagccgtgatcatatattccagggcggtgccggtgatgcggctcattaatttccggtcaatccgctccctcaggcttgtcttgttgataaaaaatccgatcagcatgctggatacaagaacagctcccaccagcagaaacccgctcataaccgggctgattttcaagaggcatgcccggatcatcactccgactaccacgaccacccctacgatagccagctgaaatgccagcggatccagggaagaggcatttgtgacgccgttaccgacggaagtacgctctttgggacggatatatcctgtccgctccgattcaggcatctcgtcgaaggtcatttttacatgcgtatatccctttttagctccatagttaatcagaatcattcccagtatgatgccgcagagtatgccgattgttgcaaatgttacgccaacgcccaccgcgtcgtcccagtaaccggcatcctggataatatttccgacggttgtggcgttgccgtgcccggcatagaacccccagacacccatgtagccgaattgatagggcagggcaataaacaggccgaacaccgcggcaatagccagtcccaaaagcatttgggcctgatggcagaaaccggccaaaaacgtggttgccatcccgtcccgtccgaccttattgagttccagcccgaggaacatggtggcgcagacaaatattacaagggctcccgaccactggccgattccgccgctgaacggaatgtaaacaggcgatacggtgccaagccagctcggaccaagaaacataccgatagttcccgctataagcgcagacggaataaaatatttctgaaaaattctgatacgccttctaagctcaaacccgatcagcagcagtgtgctgagataggcaaaatcctttaatacatctgtcaatgtcattttaaaacctccgctatcaagaatgaatggatttatgagtggattatggtcatcagagttatcggtcgtaatagggcgaatatttctccaccagggaaaactgccccatcatactgtggatccgcgtgggcggattcgtcatcttttcacttaccccaagtgtcgtcccctgggatgcaagagcttccatcacctcaatcattccctgggaagctgcaagcatggaggaaatcggaaacagtcctatggaaaaattcatctcccttatctgctctattgctacatttcctcctacaaatcctttttcattcatatttaccatcagcggaattttcgattcttccgagacttttataagctccccgactgatttaatcccatccacataagcgtagtctgccccgcgttcttttgccaggttaatccggcggatggattcatcaatgccgtagccgtaaagattggcgcaggtgcggtagacgataacgaagtcttctgatacgttatcacggactgcctctatctttggtccgaccatctcccatcccacgatctcatttttggcgggatgcatggaaggaagcaccttatcgtcaatctgcaggcccgcggcccccaattgttcgtacatggctccggtgttggcggcctggattgcatttccaaaaccattgtccgcatccgccagaagcggtacccggcaggatgacacaatatgctgaattgcatttccaaactccgccagtcccaggaatccgagatccggccgcccaagcgcgctgtaggcaagcgccccgcccgacaggaacagcgccgggaatccggcctcctccgcaattcgggccgacagacagtcataaactcccgggagtgtcagaaacttattttccttaagaactttccgcagatctcttgcgtgatttgtattcatttatatcccccttttgttagagaatgtgtcgtatttttccataaaaaggcgccttttattagatatattgtacaattcaaaacgttttatgtccaatgcctgaagagtcataaaactataccagcaaaggtatagccatgttttgcaaattgccttcacttctgatataatttaatatgataaaacaaactaaataattaaatttcaattgatactatcggttaaacttttaaaggcatggggaggaggaaaagtttcttgattgatcaaagacggtgtaaatatattaaggcaattgccgagtgccacagtttttccagggccgcacagcagttatacgtttctcagccttccctgagccgttttgtcaggaaagtggaggatgaattgggggttgaattgtttgagcgcaattcgattccgctcggcctgactccggccggccataaatatttagaatacattgaacggtttcaggctctggaatctgccatgaagaaggattttgcctccattaaaacaggtacgatcaatcagcttgttattgcaaccctgccctttttaggcacctatgttttaccgaaagtcattccccactttgctgagaactatccctccgtcaatttgcagatagatgaatataataaccgtgagctgatccggcgggtggaaaacaggacagccgatttggcactgacgaatctggccccggagtcagatttattccgccgccgtatgctcggcagcgatcccattttactggcagcggcatatgataaaaggatgcagcagcgttttccggagcaatgcggcaatattacgagccccatccccatcgatttatccaccctgcaggatgaaacactgattattctgcacccgtggcagaatatgaggatcgcagcggatgccgtctgccgccactatgacttcacccctaaaaatacgattgaggtatccagcctggcttccgccatgagcctggtcggcagcaaccgcggtatgacctttgtgtgccgctcctcgatcagcagcatccggccggaaactcccatcatctatttttccatgggggaaatgcagaatgtcactgccatcatggccgtattcctaaaggacagccacaatcccattattaataaattctgcgactgcgcagcgcagagtctgaaacgcatataggatttgaatataagacggcaggagccgcccttagagagattgaacgttctctccgggcggctcctgccgttccttcacggtaaattttaaagtaacagttcagccgggatgtaggtagtcaacggcacttttagcctgacattttaaatcacaaactgtctcatataccttgcactgagcttcaggctcctgattacatcttcatgtgttccctcaaagcttttgtcctccacttcgatacaggtataaccattgtaccctatgtcggtcaatgcgctgacatatttcgcccagtccacgtctcccagtccgggaagctttggagccatgtattccagcgggtaggccatcgtccccacattatccagcctgtctttataaagcttgatgtctttataatgaacatggaaaatcctgtccctgaactcatacatcggtttgatataatccatcatctgccatacaaaatggctgggatcataattcaggccgaaattgccgctcggaattatttcgaacattctgcgccagattttcggtgtcgttgccaggttctgccctcccggccactgtgtctcgtcaaaaagcatcggacagttttcgattgccacttttacctggtgttcctccgcgaagcggataatatccggccagatttcctcaaaaagcttcagattctcttccacgctctttgtatgatcacggccgataaaggtagtaaccatgccgatccccagcttttgtgaagccgctattaccttcttcaggtgttcaatattggccttccttttctccaaatctccgtccattgtattcggataaaacgccagagaagatatctccacatttttttctttgcagtaattcaggatatattcggcctttgcctcgctcagttcatcgacatcgatgtggctgacgcccgcataccggcgttccgccttgccgcttggccagcaggccgcctcgacgcattcatagcccaggctgctgatcgtgtctatcatttcttcaaaggacatccagtccagaatcgcgcttacaagtcccagtttcattctttccctcccgttttaccagtgtactctcggaatctcctggtactcagatttgcgagatgattttttgtcggttgtgtacatatttatgaggcgtacacggtgtgtacgttgaataaatatgtgcgcggccggcagaaaatcagccgtaaagatgagtgccggggagactccgaaagtacacacctactgttgcgttgcattaagaaattttcacgctctttcctgtctcagagctttctaccgcggcaaagactgctttcattgctgccagagcttcctccccgctgatttccggcggcgtattatggaccagacagtccataaacagatcgattactcccgactttgtctgattgtcattcgtctgaatcttatccagatcatagcagattttctctccgcccttcagctccactacaatagaatgggccgggtcactgtaaatcttcatcactccttttgttccgtagagaatcgtggagttgtcttccgctccatagcaggtccagcttgcagtcatggttccgatgcatccgttttccatcttatagatacagatggcattgtcatccactccgatgagactgcccgaggcatctcttttatccagcgtacccagataaccaattacctccgccactctggaacccgtcagatactggatcagatcggttttatggattccaaggtccgccatggcccccatgaccgctttcttcttatcgaaaaaccagacattccgtcccgggtcaatgctccaggtctccggaccgctatgggcaaaatttgtcttgaatgtgataatgtctccaatcagtccgctttctatcagttttctggcctcagcatgggcttttgcaagccgctggttgtggcctatcatcagaaaacgccctgtttcctttgaggcccggaccatatcctcgcactccttcagattcatcgccatcggcttctcacagagtacgtgttttcccgccttcagagccgcaaccgtaatttccgcatggacgttatttgccacgcagacacttaccgcgtcgatttccctgtcggccagaagttcctcataggaatcaaacgcttttcccccataccggactgccagctcttgggcacgttccttattcaaatcgaaaaatccggccagcctggcatccggattttgcgcatattccgggatgtgcctgacctgagaaatcttaccgcagccgataatgcctatattaaacatgataattccccctaaattgtgtattctgtcgttcggttaaaaggtatattacaattgtttatttatgttttttcttagactgtgccagcacggctacaataataacgaggcctctgacaagaccgtttaagaatggcggtacatttgccataacaaggattgtctggatgatacggagcatcagtacgcccaggaaggttcctataattttgccgcgtccgccctccatcgcggttcctccgatggctacggctgcgatggcgtccatctcatatccgtctccggcgctggccgcctggattgaggtaagacggcttgcaagaaggaatgcagccagaccgtacaaaataccagcgtaacagtaaatcatggtcttaacattgccgaccttgataccagtaagtcttgccgcctgctgattagaaccgaccgcatagacataacggccgaatttcgtcttagccatgataaatccggtcagcagcgtaatcaggataaagataatcatcagatgcggtattccgaaaatcttgccggatgccacatatcggaacgcatcatacatgctcttgtcaacagtaaacggaccgccctgcccaagctgtgtgataatggaacggtaagcggagaaggtcgccagcgttacgataaacggagcgatatttcccttggtgataaaaattccgttgatcaggccgagcagcaggccgaagcccaggcagaataagaggcacagtgtaatgctgtgtgtcttgttcagaagagaaactcccagtcccgatatcagggccaccgaggaaccgacggaaagatcaatcatgccggccgaaataacaaggctcattcccatcgcgcagatacctacaatcgcgccctgcacaaactggttcgtcaggtttgtaaccgagagaaatgacgggttgatgatgaccgccacaatcatcagtaatatgaagctcagccagtggctgtaatttgtcgttatgtttgaccatatctgtttaaagtctttgtccgtagtctttgccgtactcatacctgtacctccgtttttgttcctgtagaaagcgccatgacgcccgcctcatttaattcttcacgctccaggctgccgttgattttacccttgtacattacaatacaccggtctgcaatctggtaaatttccggaaattccgtactgaaaaccagaacacccctgccctgcgccgccagctccagaatcagcttgtaaatagcgtattttgcgcctacgtcgattccctgggtcgggttatccataatcattacgtcggcatctgtctccagccagcgcccaacaataactttctgctggttaccgcccgacagtgatgtgattgggtctttttcgcttccgacttttatctccatcttgcttctgtttttctcaaaacggctgctctcttctttatttccgataattaacttcttgtgcagcagcgtaaagtatgccattgagttattatccctgatgctcaggtccgggagaatgcctctctccttcctgttgcagggaatcatcgcgacgcggtggcgcatcacattgaggatactcttcgtattcagcctgccgccccttgtctcgaccgtaccgctttttgaaggcgtggccccgaacagagcagtcgccagctccccgcttcccgccccctgcaggccggtaatcgcaatcacctcgcccctgtgcagatcaaacgatacattttcaaaggtttctccggtgagcccttttaccgacatcaggatttcttcccccatgcacggctcctgctgctccttcaggttggcgtttacaaatgtctttccaatcagaagctctgtggcctgatgttcattgatgtcctttataaaaccggtctcaataaacctgccgtccctgagaaccgtatatttgtcgcaaattgtgaaaatctccggcatcttgtgtgaaatatagataaagcttaccccctggcccttcagccttctcattatggtaaagaggttttcaatctcctgattgttgagcgcggtggtgggttcatccataataatcagctcagactggaataaaagcgcttttgctatttccacaagctgcttttttgccgtttccagatcagacaccagcgccatggcatcaatctttacattcatgccgtccagtacttcctgcgccctctgaatctctgttttcttatcaattacccctgctttattcgtaagttcttctcccaggaacatgttttcataaacctttaaatcattacacaggttaagttcctggtgaatgaatcggattttcatttccattgacttctgtggagtcatatttgtaatttcatttccgtcaattataattttcccggaggtgggaggaaaattaccggataatatattcatcaatgtggtcttgcctgctccgttttctcccagcaggccgtgaatctcaccggctcccatctggaaatccacattctggagcgccaggacagggccaaattccttactgattttctgcatttccaatttcattagcaaaacctccccgtatcatgaagataagccggccggtttgaaaccgaccggcttatcattctaaaattactgtaagctgtaacgaatcttgtataagtcagattccatgtattctttataattatttttatcaatcatctctgttgggatcaggtagcttggctccagagtctttccttccagtacgtcaagtccaaggtcaactgcgtcacgtaccatggatggggagaacgtataggtcataaagtcaatgccttccagaccggaatcctcgaataatttcataaagccttcgcctgcggaaacgccggagatgagtttaatgtttaattttgcagggccgttgtagttcttaagggcctctacgataccaaacacgatttcgtcgtcatgtgtaaagattgcctgaacggattcgatttcttccacgctctttgtgtttaagaagtcttccatctgctccatggctttctgctggctccagtcagtagaaaattcctggattttcttaaagttgctgtcagctgtcttccagaagccgttggaacgctgcatcggtacggttgaggaatcgcctttgaactcaagaaggccaacttcgcctgctgccagttcatctttgaagtattcgctgaaatattcgcctgcgccttcaccgattgcatcgttgtcgcccataatccagcttgtcggctcaaatccttcaattaaacgatcataaatgattaacggaacgcctgcgtcctgaacctgctgtgcggagcttcttaactcatctcccgttacgggccagagaaccataacatccggattcattcctaaaatcgtctctactgcgttgctctgctcaccggactctgccgctgtcatgaatttatactcaaatccatatttttctgcaagcatctttacttccgcctcacagtgctgaatggattctgctgtaaatccatggtcggctgccggtgtaacgacacccatcatcttgccttttaagtctgttacttcctctcctgcttcgggagcttttgtctcttcccctgccgcctctgtcgtctccgcctttgtctctgctacggatgccgctgctgtctccgccggtttctggctggaacatgcggtaagggacattgccattgctgatgcgagtactactgccaaaacttttttcatgttgcttcctccttgtttttgctttttggatacttctccttgtttattctaaggctcaagccgagccgtcgaatcacgaattaccagcttatgttccaggaagattttcccctttccttctccggactcaatctgatctatcagcatgcgggcgctggtcttgcccagtgggtaaagcggctgtgacaccgttgtcagcatcgggttcatcattgtggcatattcgacatcgtcaaaccctactaccgatagttcttccggcacccggattcccaatcctccggccgcccggatggcccccatggccaatacgtctgaaatgcagaacacggccgtcggcctgtccggccggtccagtaactgcctggccgccgagataccgctctggaagctgtaatcacggtctgcatatgccatatattcttttcttatgggcagccccagcttctcaagctccgcctcataacccctccggcgatcctcactgctgataaactggttcacactcccgacaaatcctatttttttatgccccaggctgtgaaggtaacgcaccacctgtgcggccgccgcaaaattatcgacagaaacatgcgctatatcggcatccttgaaaaattcgcagcactgtacaatcggcactttatccgcaatctcctttatatgcctgttatccttattaacacagagcatcaccgccccgtccgcctgtccgtcgaataaaagctcgataaactctctctctcttacttcatctccattgacgatacagagcatcgtgccaaactggcaccgtcttgcctcgtcctcaattccggctacaatggatgagtagaacgggttgctgatcgtcggaaccagtattaaaagcatcttgctttctttccttctcagcctgcgtccccacacattcggctggtaattcagctttgcaatggccagcgccactttttcatgggctgccggcgataccggaccgttcttgttcagcaccctgctgaccgtggcaaccgatactcccgcctctctcgctacatctgctattgtaatcataatttccttcatcccctctgtcttcctgtcgtattccatttgctgtttatgtgtaatcgattacactttatacaaaaaattatactttgaaacaagaaaacaggcaagtactttcagaaaataaaatcaatgcaataaccttgtatttcacggaaatcacttcccatttttccttcggcaggggctggaaccgttatattgaattaatgtgtaatcgtttacacatttgcgtttaaaaatagaaatcccgattccggaacctcttttatttaactattttcagtataccagcttgacaataaatgtcaaggactttttgactttttgcacataatcgccgaaaatgcactgtcatttttatgcactttaacccaaaatccggggttttcgtgaggccggaagaggaactattgtccttccgccggccgcaccggcttcagattcacctgcctgaccagaaacgaatcagcctcccagtcctaaaaaaccaggtacaagcgacataaacaacggattaaaaatgtcaacacacaaaacggaaaaagcaggatacaatatccaggcgatatgggaatatccgtacttatccataacagctctctcattagccaccgcattggaaccggatcccattcccataccaatcagccctgcacacatacaggcggcattatagtcgccgtgatacatacggaatcctatgaaataagtgaaaacgagagtggcaatggtcacaacaaacagaataatcagcattgggccaaccgcatttgtaattctgctcaaatccatggtcataatggtaattgccaggaaaatatccagtgaaatatgctccaccgtctcaacctccggcagatggatatccacatggaaagcctccagaatatttctggcaatcgccccggcaaaaagacatccgataaaatacggcatttcaatatatggtatcatgctcaaaagcatataaatcgggatgccgcaggctgcgataatcgttatcatacagatagtgcttaaaagttttcccgtatccagcgccgttttctcctcactgcctccggcctgcagcgcgccgtcctgcggatccgcttttaatttataccgtttaatcagcattacggccagcggtccacccgtgaggcttcccagaatcatgccgactgttgcggccgaaactccaatctccgtcgctcccacagcgcccatcccttcatatacgggaccaaatgcagatgtagttcccacgcctcccgccagagcgcctgtgccgatctggattccaagcagaggatgcaggccgagcatctgggccagaaacattccgagcaggccctgtaataatacgagaagaagcaccgacagggctatccccgcacagaacttttttccgcgctccagcagggttttgctgaaaccaaaacccacacaggtaaaaaacagattcatcagatggctgccgagtgtagaggtccattgaaccgcaaacaatcccgtaattttaaggtagcttaaaataagcgcaaccagaagtcctccgacaacgggcgccggtatcccccagtcctggaacggctttactcttcgtacaattgcttttcccaggaaaaccataagacacccaaatcccgtagtcgcaagcagatccagggttaacgttgacgttgctgcatcaaatcccataatacttttcctcctcattcaaatatacttcatacggcatgcctgttaccttaaaatatactagtatcggatcatttgcaatcattttcagtcttctttaacatttcctgaatatatgttatgattatgaaattatttatttccagtcaatacattagcagtcaatatccccgaattgtatttacaaaagttacaaaagttactatagttacttaagtcatttatgctttaacaatgataaactcaaaaaaatatggcacagccggaaacgataagcgtttctcagccgcaccataccatgcggtaccttttttatttaacaaccggaagtttcatgactatctttgtataggattgctgccgggacgtatggcgcaccgctttgtgcccatcgtgcggaaaggcaatatagcacatccccgccgtaatcctcatcacattgtcttcagcgcctgtgtaggccaccttatcattgtcaccgttatattccccgtcttcttttaaatctcccagatccgcccaggcgatttcttcgctgccctctaggacaatctgaacatctgcatattttctatgagcctcaaatgtcccctcagacatcggctttgtctctcccttttgaaccaggaagaaaccgccgtcgaactcatatcttccggcctccggattgcgcagcgcctctacggcctgcagaccgttctccagattattgagcatacagctgtaaaaacggatattgtcaaatttgtcaattatcattgtgtctttctcctaattttcaaccacgctctaggctgcggcgcttgcagaggctttcgcttctttgtgcttcttaccctgaatgtagaaatataccagaatggccagtcccatcgggattccgatcagggtggtgatattttcaggaataatgataaatactgccacgcaggccagaagaacacggactactacgttctttatcggtacaaacatataacctgctataccgcctgccaggaaaataattccgtatgccataatcgccgtattcaccaccacctccgtaacggtaccctgcagcagaagagccggatggaacacgaagacataaggggtcaggaaggatacaagtgcataggcaaatgccgtccagccggtcttccacgagcttgcccctgcgataccggcggcagtaaaggacgccaggcataccggaggagtgatctgtgcgataacgccgaagtagaagataaacatattggcaggcagcgggtcgattcccagggaaatcagtgtggaacagaacagtatgttggcgatcaggtaagccgcaaccgtcggaagagccataccgagaagcatacatccaagcattgtgataatcagggccagagcaaggctggagcttcccgttgccgcaataatttttgtcagcttgttggcaacgccggactgcaccacaatacccgtcatgataccgcaggcagcggtcgggattgcaattccgtatgcctgttttgttccgtccagcatcgcatcgataaactggcttacgttcattctggtatcttttgaaataaagcttacgattatggcaagcgccgaacctacgagagctgcccttgtcaaagagcttcccataaatatcatgactaccagaacaataatcggcgcaagctgatagattctcggcataatcggggctgtcttgcagacaacggcctcgtcatgggaattcatttttttcttctttgcgaggaaatgaaccagcaggaatacggaaccgtagtatgccagagccggaatgatggccgccatggcgattcttgtataactgatgccaatcatttccgccatgatgaacgctcccacccccatgataggaggcataatctggccgccggtggaagccaccgcctcgattgctcctgcctggtgaggctcatatcccgatttcttcatcagcgggatggtcatgacacccgtactcgtcacgtttgcaacggctgagccggaaatcatgcccatcagtccggaagacactaccgatgcctttgccgggcctccggccgtcttgtcgctgagtttcatgcctaaatcgatcaggacctggccgccgccgcacaccgaaaagaatgcgccgaacagcaggaaatagaacagggtattaacagaagacgacagcggcgagccaaggataccgttcggatccatgaccataacctcgccgaagctctgccatgacataccgcggaatttaaagatgccgctgattttctgtcctaaaaatgcatacgcaataaatacacagataaagataaacaggttcatacccataaaccttcttaccgcttccatgacgataatcagcagccagtatgcacagagcaggtcggctgtcgtcatgctgtccacgttatagatacggttctgcagataacttaaattagaaataaaatagtacgcacagtaggcaacacctgccagcatgaaaatatcataggcccagccgagcgcttttgttactgtagttttgcacttatccgcaacgggtttgtgaataaaagcgattgccagagccagacagagatgcaccggcacctgaatccatttatcaagcggcctcaccagcgcaatatagagctggaaagcaatcaacattacggaaagtataactaacgaagcatatctccactttggaaggcttgcgaatttgctaactggcttttgatcctggttcagggcattcgcttcactcataattcattcctccaatatctcttaaaagaggggagccggtaacagccccccggactttaaatcctgattatttcatgtaacctgcttctttaaagtatttttctgcgcccggatggagtgcaagaccgccgactttctccggctcccagcatgtggcagggtcaaacggctcaatggatgcaagtactgatacaaggtaatctctgttctcacacatggattttgtcatccagtaaacaacgtcttcgtccagttcatcccttacaaataagcagtcaggcgtaccggcattgatgatttcctccgtctgtcccttccaggagttggccgggattgtgattctctggaaacctttttcgtttacaaagtaatcaagcgtatcctcttcccactggttgaaatgcacgtcacacgtcattgcgatttctgtcatcgtggaggagttgacggatgtatggtcaagcatgaaatccagctttccgtcttttaccatagcggagaggtcggaaccgccgccgtgcactacatcgccgccccaggatttgatatcatcttccgtcactcccaggtatccgagtaaaatctgaaccacttcgttatccatggagcctaccgggctgcagccgattcggattggaagtttctgtctgattgcttcttccacggtctgtacattgtatttatccatgaatgcttttgtcataaagtttacggccgatacgttggtaagtccgccaatcatggctgaatatccttttacaggaggtttgccgagggtgccctcttcaaatgcccattttgcaggagcgccgttgataaaggagacatctgtcttgccctgctcgaacaggtaaggagcgcccattccgccaggggagattggctgaacgtccactgttccgattccattttcctcccacagcttcgcaagctctgccgacaggttataattacttgttccgacttcgtgtgttgcgaataaaatatttgcgttcaggcctgcattggccgcttctgccttatcttgtgctccgtccgccccgctttctgccccggctgcctctgtacctgcggcctccgctgccggcgccgttgtcgctgccgtctggctgctgccgtcattacatcctgcaagtcccaataccattgtagctgccaaagctacggaaacgagttttttcatacttttcttcatagtttttcctccactattctcctttttttactttgttgcttttagctaattttacgccgtaatcaatggcgttcatcagacttaattcatttgctatgccgagccctgcctggtcaaaggctgttccatggtctacagatgacctcacaatcggaagtcccaaagttatgttaactcctgcaactgcatcccatttcttctcattcttgttataaacaaaactaacaaccttaagcgggatgtgtccctggtcgtggtacatagccactacgatatcataccagccgcccctcgctttggaaaagacggtgtccggcggcaccgggccttctgcgttgattccctcttttacggcctcgccgattgccggtatgatttcttctatttcctcgcggccaaacagtccgttttcaccgctgtgggggttgagtcccgcaactcccaccttcgggttttcaattcccaggtctttacatgcctgatgggcaatcctgataacctccagcaccctgtctttttttaccctgtcgcatgcctctctcagcgccacatgggtggatacgtgaacgacccttaagttttcatgggccagcatcatcgtgtatttctttgttccggtaaaatccgcatagatttcggtgtgtccggaataatggtgtccggccaggtttaccgcctctttgttaaacgcgtttgtgaccgtcccgtctatctcgccggccatggccagttcaatcaccttctttacatacccaaacgccgcttcaccggcggctaccgatacttttccgcgctccagcgtgttcaaatccatcagcttcatatcgtaaacatcgatggtaccatactcgtattttgcctcaccgaccgattggactgcgcggattttgatatcctctcttccggcaatcttagcggcctcctccattactgctgcatcgccgattaccagcgggcggcactcgtcataaatttctttctttgccagggcttttacggtgatctccgggccgatgctggccggatctcccattgtgattccaagaattaatttctcagccatattctgcctttcttttattcgtgttttccgaactgccaatcagcacatgcccttttcgtgattctcggcaagcacttttttgagcgcctcgattccttcctccggtacctggttaaacggcgcacggcactttccgaccgggtagccaagcaggttaacagccgtcttcacgatggtgttcggattgccgtatttaaagcagccccggaaggaacggatactgtcctgggcttttcttgcattctccaggtcgcctgccgcaaaataattgtagatggaggccatcacctccgggaacacgttggcgcagcccgcaatacctccggtcccccctgccagaaggttccagagaatcagggaatcgttgccggaaagcaccgcaaagtctttgctgtccctggtctgttcgatatactgaagcatattgtcaaagttcccggagctgtctttcgctcctacaatatttggaattttgcttaattttgcaacggttgccggcgcaagggcgttgcctgtcctggccggaatgttatatagaacaattggcatatccactgcctccgccactgccttatagtggtcgtacagctcattctgggatgccgcggcaaaggacggggtgatgatggaaagaacatcggctcccagggattctgccatctgagactgccggatggtatcctttgtactgatacatcctgtccctgcgtaaaccggcacgcggccttttgtctcatcaataacaatacttaaaacttcttctttttctttctcgtttaatatgtatccctcaccattggtgccaaatgggaaaagtccgtgtataccgcctttgatctgccggttcacctggttgcggagttctttctcattgacggattcatcttcattcatcggtgttacgattggcgggataattcctttaatttctacttttttcattacctggttcctcctgattttgaagctttgccacagttcattcggctaattaaattatttcaaggtatattttttttgcgtcttcggccgtcacagttctcatgttattgacgaggagtctctgcacgcccattccggcttccacaagttcatccagatcctcgctgccgatgccgaattctttcaggcttttgggaatattcaaatgctctacaatctcttccatccggtttacaacccacgccgatttttcttcctcactctttgcctccgttgcgaagctctccccggcggccagccggtcgtaagcttctgcaaagaggccccggcacaccggttcgttgaatctcataacaggagccaggagaatcgcattggacacgccatgcgggatatggtacctgccccccaaaggataggacagcgcgtgtaccgctgtggtacccgacgcagtgattgcaacccctgcgtagaaggaggcaaccagcatattgttcttctctttaagcgcttccgggtcgtcgcaggctttttctatatttttcataatcatttcgaatgcctgcagagcaaaaatatcactgaacgggttctttttatttgaggtaaagcactcaaccgcgtggcacagggcgtccacaccggtggatgccgcaatttttctcggaagctccttaatcatgacagcgtccagaatgacataatccgcaatcatattatcattcacaatgccgacctttaattctttctccggtacggcgacgattgcattgggagtcgcttcggcacccgtacctgcagtcgtcggaatcatcagtgttttaacgcattttttcgccatttggggattatccagaagttcctttaccccgtactcatcggttgccaatacggatgccagcttggcggtatccataacgctcccgccgcctacggccacaataaaatctgctcccgattccttaaatgcatcaactgccttctgcgcctgctcataggtgggttccgccgccagatcatcgaaaatcacatattcgcagccggattctttaatctttgaaagaggcagctccaaaagccctgctccgataattccccggtcggtaaaaacagcggtttttttgacgccggttccaataatctgcgtcagtttatcaagagcatcttttccgctgtacactgcgtgcggcattttaagcgtatactgtgttaacatacttattctcctctttcttttccagtctcttatcttctttgcagcctgttatcttctcagccaaatccaccatcagggtttcgcctccgaaacctcccgatttggttattaccgcaaatgtcctgttcccgatatcgatttctgagaggacggttcccggcgccatctcacagaccggtgcaatttcatcacggccgatatgagccatgaatccggtcaggcagtcgcctccggtaattaacagcgtgctgtcgggttcctcccctatcagctctctcaccacatatccgagggtggaagaaattctgactctcaattcctccgtcgtgatcccctgcctgcacgcataatcaaatgtatcgctccggcccggcaaatcatttgtatcaatgatggcacggttgctgcggctgcacagctctttccagtctttcaggtttttttccccctccggcgtccggtagtatccggtgtcgaacttctggtgcggagccatcctgattcttgtaaatccctgacgttgtgcataatcaagttgcctgaccgttatcggattgacactcccgcaggctacaaggaatttttcgcccagagctacctgtctcggcctttcgccttccagtcccagcaaagatggtaaaactccggcaaaaccggcgcagcctgccataacggtcagttcaccttttttcatcaggaactttccaaactccataagctcctgatcgcttgaggcatcgtaaaccatgattcccggcgccctcttccagtccttcatattgcggaccaccgtcaccggcacatcccccttcagtatctccgggatatatgaatcggcaaccggctcaaacgggtctttgccaaatacactctcatgaaccggaacgccgtcaatatagtggattccattcctggtaatccggttcatctttggaaatgccggaagaaaatggagggaggtccgcgaagcggcatcaagaactgctttcagttcacttccgatatttcccctgagtgcagaatccgttttcttgtatataaatggaatcccgctctcaaatgctttttttgtaatgtggaaaacaactctgtaagcttcatcccgactcaggtgccttgtctctgcgtccagaaccagaacctgcacattctcatccacgctgtcaaaatcgtaatccgtattagtaacaactcttgtctctgctccacctgccgcaaactgtactcctgtatcaagtgcgcccgtgaaatcatctgcaatgatcagtaatttcaccatattgtttcctttcccgaccaaagccacatcgtttcatttttaaacaatagcttctcataatttattgatgtattttctgactttctgtcgtttattgtttcatttcctttgatttgttttattttactaagaatattatttttgctcaaccttttttacccgttttgctgtttatatttgaaacacttttgattttatatttattattttgttgttttatgttacaatcgtttcataatgaaacacgtttatgttaagaaaggggaactctatgaatcagggaaaaatcagaattctcggcatagcgccttacgaggggatgaaatccattatgctgaaacttgcaaaggatcgcgacgatattgatttgagcgtatttgtcggggatctccataaaggcgcagagatcgcccggaagaatttccatgaagacttcgatattattatatcgcggggcggcacggctgaattaatcggagccatcaccccgcttcctgtaattgagattgcgctttccgtctacgacattctgcgcgccattaagatggctgagaatttttcctcccgctatgccatcgtcggtttccccggaatcacaagcagtgcccagctgctctgcgatcttcttcaatataaggtggagatctatacaatccacagtgcggacgaggtacaggatattcttttaactctcaagaaaaagggctaccggatggtgctatgcgacatgatcgccaatacgacggcaaaaaaactgggactgaatgcgattctgattacctccggcaacgagagcattggaaacgcctttgatcaggctgtcaaactatgccgcagccattcccttttacgtgaagagaataaatttctccagaatgtgattcttaaggacagtcacgaaacagtcgtattcagcgataaagaggaagtctttttctcgaccctggaatccgggtccgagcctctcataatcgatgtactgaagcgggaggtttctgccgcactggcggccgatacccaccgttcctttaaaaatatcgggggagtcctgtattccatcaccagccgtctgatcccgttttacgggcaaaactacgtggttttctatttttcttcaagcaaggttcctttcgcgaccagcaaatacggcgtacagtatctgagcaaaaaagatgtggaaaatacgttctacaacagtttttataatgtaaccggcgccatcggcggtttacaggccaccgtcgaacagatgactcagacggattttccgattatgctcatcggtgaggccggcaccggaaaggagagggttgcaggggctgtctatacgcagagtccgctgcaccacaatcccatggtcgtcatcgatttcaccatgatgaatgacaaaagctggacattccttacaaaccactacaattctccgtttaatgataataataatacgatttacctgaaaaatgtggatacccttccggaggaacggcacaaacagcttctttccctgattgtcgatatgaacctggcccgccgcaaccgtcttctcttctcctgtgtatgcggtaaggacggagtaattccaaaacggtgcatggactatgtcaacatgctgtcctgcctgaccatccatctgccgccgctgcgggagcgcagggaggaaattccggtactggctaacctttccctcagttctctgaatatcagcctggccaaagaaattctggggctggaatccggggccatggagcttcttgttaattatgaatggccttataattatactcagtttaaacggattctcagtgaactgacggcagttaccaccacgccttatattctggaaagcacggtggcccatgccctggagcaggaacacacctccgctgcccttctgcctcattccggtattcagaatccggtgcagtcctttaacctgaaccgcacgctggacgaaattaaccaggatattattcacgctgttttggaggaaaccggtgggaaccagagcgctgcggcaaaaagactggggattagccggactactttatggcggcttttaaaatcatgaaccggcccctcttttaattttaatatctcttttagactatttttatatattggtcaaacattagacacaattttccagtatgatagttacataaatcaatgaggccaatgacatatagaaagcgcgcaaaaggtcattgggctcgactaacaataatttacctttatatagatttctgaaaacttttctacttccccctttccgttttcagaaaaagcaggagtcttactttcgccgtgaatcatctgattctgcggcgccggtaaggctcctgctttatttacccatccttcttctttcctaaaattcttttttcctaaaattcttctttcctaaaattcttcttcccagccgtcctccgttctgccgaatttgcgcccggcatccgcatagaaataggccaggatggtcggatccagattgcagaccgtgttaaaactgatgatcgtattattttcagcctgatttacatactcatccggctcatcgcccacaaaaaaacgccagccgcagtctggaaatccttttgccggctcatcccggtacatgtaaccaatcgtttccgtctccatcgccctttttgtaatgatgcagcccggattagccccgaaaatatcggcccattcacgttcctgcggcctgtaccatgcgtttctcctccacgcccctccgtcctcaaacaagtggcgtaccagattataattcagcttataaaagctttcatccacagttccatgatgactcataaaatatacggctccgcacagacagctgattgcgtattcctgccaggaatgataaaacacctgggcctgcctgacccatggatccgtcagttcccaaaaccgttcctccgacacaatcccacaggccgcagcttttctcagcagtccaatcttttcattgatatcccaggcataatatcccttttccttcaggataggataaaaatgtcttgagaggctgatgcattcctcaaatccctttcttccggccccattcagttcatttatgtcaaacatcggagcgccgcaccagaatgtcatgaactgctcatactgtctgctcccggaatactcactgtggcaggcggactgaaatgcctcctcgttatggatgccgtatatcctctgtaaatgttccctggttttagcctcctcatcggcgtccgcacaatggtacagctcttcatatcccatatgcaccggaatgccgggggcctttctgcatgtggaaataccgctcaaaagcagtgtgaattcttcacggctgaccggctttgcctctttagtttcaggcatttcctccagttccttcttaagttcggtaaccatctttacaatattttctatcgcattcatcttttgcccctccaaagccggatctaaatcctaatacgccaggacctcatacccgtcatccgtcaccaataccataatctcccactgtgccgaaggctcgccgtcggccgtgtaaacactccagttatcggtgtcgtctacataaatctcattggttcccatattcaccatcggttcgattgtaaaaatcattccgggaaccagcatcatatccgtcccacgtgtccccgtatatccgacccacggctcttcatggaattcgattcccacaccgtggcccccaatctcccgcacaacggagtagccgtttttaacggcatgatcgtttaccgcctgtgacatatctccgagaaatccccatggttttacctcgcgaagccccagttcaacgcactctttcaccacctccaccagacggcgtttctcagggctgacattgccgatgcagaacattctcgacgaatcggaaaaataacctttatagatagtggatacgtccacattaataatatcgccgtctttcagcacaatatcctctgatggtattccatggcagacctgctcattaatagaggtgcagacactcttcggaaatccttcatatcccagaggcgccgggatcccgccccgttttaccgtctcatcatacacccatttatctatctcttccgttgttatccccgccccgatatgttccgcaacataatcgagcaccgcgatattgacggcgcagctctccctgattttttctatctgctccggagtcttcaaaagatcgcgtgtcggtacaatgtgacctttatccgactccgccataagacgttcatcgagggcctcatggcaatgtttatatttttttccgctgccgcaccagcaggcatcatttcttcctaatttcttcattttattcctttctgaaaacaacatttactgttcccggccccacaattcccgccccgcgggttataatgcccaacagttccagtgctccatccggccagtaactacagtgacaggccggatggagtactagctgtactatctgataagattctactgaattggagtgtagcacaaggagggcaaaaaagcaatgttcgcattactgttcaaacccaatgttagttaagcaggatggagatttaactgaggtgtggaggacgcgtccggaacgaaccatgtccggtgtggtgagggggatgactgagtcttccgtccccggttggagggtgtcgtgatgggggaatccggccggaatgaattgctgcggggaccgtttgcactctttggagtgcgcagcagtgctaagctcgtgagggacctcgctaagcaccggcggactcccatgtcccctccgcaattgattccgcctactttccctggtcagtttttcgtcggggccggaacactcaggcggaggtttttgacaccggacatggtccgttccgggcgctgattgtctccaaccttaaatggagagggccctgtcgcgaccactacgtgtttccggcaggccgatatcaaatcttccacaattccttaataaaggtgcattgaaagcatatcgtatttcccgttcacggaagctcttagtggccgcgacaaggtccgccccgcacttaacgcgtgagacattcagcggccgcaggccagcggacggggccgatacactcagcagagtctttcgtcctggcgaaaacctggccttggggcggaggggaagataaagtctgcggatgccgtagaaatccatcgctgattagcgaggtcctgtcgagcttagcagcgcgatgcatttcacagagcgggagcgtgctccgcagactttatcttcgcccgcagccccaaaccacaacaatcttcccccgggacgaaagactcataaaaccaccccaccgccccgtccgctggccgtacaggcggcgtcctcacctgcttaactaaatctccacatacgcaattttatcacttttttaacgtctcatcgttgctcttttgacatgaatgattgtataatgttaacagagcagtaacagctgcaggcaggaggaatttctttatatgtgcagtcaggataacggcgacatgaaaaaacaacatgcgctttttaaacaatacggtacgattaacgactggatagtgaccggcgccttacttgccgtcgctacctgtctctcctatatattttttcatattatggataatccgaccgccaatatcgccctgtgttatattctggcgctgtttttaacagccaggtttacgagcggatatttttacgggcttttcgcttcgctgtttggcgttgtctgtgtcaactttttatttacatatccttattttgcgctggactttacactgaccggatatcccatcaccttcatcgccatgttttccatctccatcgccacaagcgccctgactacgaatatgaaggaacaggcaaaggttctttccgaacgtgagaagctcttgatggaggccgagaaagagaagatgagagcaaacctgctccgggccatatcacatgatttgcggacccctctgaccagcattatcggttcgagtaccgtttatctggagaacggcaagtatctcacggagaccgaaaaaagtgatctggtctcacatattctggaggattccaactggctcctcaacatggtggaaaacctgctgtccgtcacacgtataaataatgaaaccactaaagtaaataaatccctggagtcagttgaggaggttctggccgaagccgtactccgcctcaagaagaggctgccggatgccagagtgaatgtctgtgtacccgatgaagtgctgatgattccaatggatgccgttctgattgaacaggtattgattaatctgatggagaatgcctttgtccattcaaaaaccacggagccggtagaatgttacgtggatacaggcgatgattatatcacgttccatgtacaggatcatggaattggaattccccctgagaagttaagcactatcttcgacggttcttcttccaccaccagtacatccaatgacggaagaaagggaatgggcatcggtctttccatctgtaagacaattatagtcgcccatggcggcgatatcaaggcagccaaccataacaacggcgccgaattttatttcacattgccaaaggagggctcaaaaattgactcataaaacatcgattcttctggtagaagatgaaaagaacatctgtgattttatttctacctctttatccgcgcaggattataaaatcacggaaactcattccggaaaggaagcgcttccgattatcacttcccagtgcccggatttgattctgctcgatttaggccttcctgatatggacggaatggagattatcaagcaggtgcgcacctgggccagtatcccgattatcgttatctccgcccgcacacaggagcaggagaaggtgaaagcgctggatctcggcgccgatgattatctgaccaagccgattgggacttccgaactgctggccaggatccgcaccgcgctccgccacagcaaccggctgaatacggactcgccgctttacaaaagaccgtttcacgccagggatttgaccattgatttcgaaaagcatctggttactcttggcgaaaaggagattcatctgacccagatcgagttcaagattatctctctcctggccaagaactccggccgtgttatgacatatgacgccattatttctaatatatggggaccctatgcagatgatgacaacagcatccttcgcgttaacatggcccatatcagaagaaagctggaacagaacccggctgagccacagtacatatttacggaaatcgggattggataccggatggtggaggatgaagcagggaattaatggctgctgcgcttgttgtaacagttcagacaggaaggctgctaagacctgattggagatttagttaagcatgtgaggaagccgccggtacggccactcagtgctaccgtgtacgggaaatacgatatgccttccatgcgcctttttaaagaattgctgaagatttgatatcggcctgccggaaacatgtagtggccgcgacagggtcctcctcatttaaggttggagacaatcagcgcccggaacggaccatgttcggtgttgcacgaatctccgcctgagtcttccgtccctggcgaaaacctgaccgggggaaggaggcggaatcaattctgcaggggatatggaagcccatccgtgcttaatgaggtttctcacgaatttagcacggctatgcgcttcgaaaagtgcaaacggtccccgtaagaattcattccgaccggattcccctcacgacaaccttcaaccagggacggaagactcagtcatccccctcaccacaccggacatggtccgttccggacgcgtcctcccaacctcagttaaatctccatttaattcagctctgcatacagctcattccagtgattcatgatttcgtctttgtgttctttcagatagtcaaaatcaagctccttcatcccaagcgtatcttctgcaggaaggccgcttaaattacagtttccgttagaaccgcgtcctgccgatacctctgcccgggcgtcctgaaattctgccgaagtaagaagatcaatcatggcctgagcagccggaaggttcggggcattcttgacaatcgccgcgccgcctgccatagctgtatttccttcttccatatagacacattcgatcggcgcgccgtcattgattaatgccactacacttgattcatatgaaagaccgaccacatactcgccgttgctgaccagattgtagacatctttggacgatgtagtggaaaagctggccggaatcagtttcttaatataatcccaccctttttcatcatcgaatttatctcccatcacagccaggattgtctgaagctgacgccagcccgacgacgtggaatccggtgcggcaagaataatcttccccttcagggcagggttcagtaaatcttcatatccgttaatttcaatgccaagttcatctctcaatgccgggttaaccacgagacacatcacctgtacatcataaaaattatagtagcctgcatcatcgtgataaagctgttctttatcacatgcgcccgtatacggctgaagtatgtcgtgataggtgtcgccgtcagcggcaaacatccctccgattaccacatcagcgtcgcacgattcatcgctccttatcctggttgccagggttccgactgagtcggcctgaatctcaagttcacagtcagggtagtattttttccatatatcattaagtacctgctgctgagtttcctccatcgttgtatataccgtgattttcccggttacctctgatgccggcctcacataatagggcctttctccgctgtcctgctcggcctgttccttcgcggcttctgtcttcgtctcttctttttttgtctcggccggggcttcttttcctccacaggcagtcatggataaaaccattgctgcagacaaacccgccgccatcagtctttttttcttcataaatatcctccctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccgcttcgaattaccgaaaatcctatatcggaatggaaaagaccgatcccacggatgcatatctcatcgcggacttcggcagggtaggccgcacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgctttcattctatatgttttattttgctcttttaaatttgtttcctgccggacagctacatttttacgtcttccagcttggtaaaacgcagatagactaccagacagataatggtcaggagcattgttatggtcgcaaatacagccgccacaccatagattccgctggtgattgccgagtaggtgctgattgtcagtgtaatcgttctgttattatacagaatcacccccgatgacatttcagtaattatggatacaaagcttaaaactgctcccgagataatcccgctggacatcatcggaaccgttattttaataaatgccgccggttttgaggcccccaggctcaatgccgcctcctcaatattaacggggattttcatcatggctgccgttgccgaacggctggtaaaaggcatacgccgtatggccagcgctatcaccattatgaagagggttcctgtaagcgtaaacggttttctggaaaatgccaccaccagggcaataccgattacggctccgggcatgatatacggcatcatggatattgtatcaattgcattgttgaacaggttgtttcttctcactaccagatacgcaattaaaacggcaattacgataatcactgcgagagtcagcgcactgacaattaatgtatttccgaccgatcgcatcagcattttctccagcgctttctggtaattgataagggaatagcccggtttcaaaatgctgtttttatagtttctaaatgacatattaacgatatatatctgcggcagaagcgaaatcccaaccaggagatagcagtatgcatgcatcaggaagttaccgaggccggtggccttcttcggctccaccggatggagagcattaatcgtgaatttgaaccggttggatgctgtcttctggataatgaatattacagcggtcaccagtaccgcaatgacgctaattgcagccgcaaagtggtagtttgtcccgttttcacccaaatactgattgtatatcagtacagggaaggtgctgtacccccgtccgatcagcacgggagttccgaaatcggcaaaggaacgcataaatacaagcagcgctgccgccagaattgtcggcatcgtcagggccataatcaccctcttaaaccgatccacacctttgcagcccatgctctcggccgcctccagcagagagttgtcgatatccctgaatgctccgttcatatagattacaaccagcggaaagagcttcagggtctgcacaaacacaattcctccgaacccgtagatggatacaccgttaatcccaaatgattttagtattccggtaatcagcccggagttgcccattaaaagtatccatgcataagctccgataaatggcgccgacatcgtacaaagcaggcagaggacgaataagagcttccggccgccgagcctgaaaaaggaatagaaataagcaaaggggatacccagaagcaggctcgccgccataacacagaacgcgattttcacactgtggaatatggattcgtagtaataggacttactgaaaaacatccgaaatgcttccatagtgaatttcccgtctgtatatacagattccttcagaagcctgccaataggataaaccaggaatataagaaacaggaccattaatcccccggaaataatattccagaaatcccagcgcactttcgaatggctcatccgctcacctcccgtcctgcctcgtcccgggggatgtccgtactgtttttaatccccttcatcaggcttttcgtcgtctcggggtcaaaaatatttgctttgcggctgttcaaggtgagtaaaacccgtctccccggtggaataatctcatcaatctccgactcctgaatgatttccgctgtttctcctgtctcaagctcaacgaaataatgagtgttggaaccaagaaatacgctgtccatgatcttagcgctgataccttccttcctctccccctccgtacacttgtgcacaaacaattcttccggtctgacggataaggtcacatcccgttccctgatttccgaatcctgtactgagtccatacaaatccggtatccattcggaaactcaagcactgcctcccgtcctttttgcatcagcttagcattcagaagatttgattttccaataaaagttgccacaaacagatcggccggtctttgatatatgttttttggctcgccgcagtggcggatcaccccgtccttcataactgcaattctgtcggagattgccattgcctcctcctgatcatgtgtcacataaaccgttgtaatgccaacctctttctggatattcttaatcacggtcctcatttcgacgcgaagctttgcatccagattcgacagcggctcatccattaaaagtacatccggctgaatcacaagcgctctggccagcgccactctctgctgctgccctccggacagccgttccggcattctgtctgcatactgatctacatgaaccagttccagaaacttctgtgcctgtttcctcatctgttctttcggcatgtccttatactttaacccaaactcaacattctttcgcaccgtcatattaggaaatatcgcataattctgaaataccattcctatgccgcgttttcccggctccatatcgttgattaaccggttgttaaacttaaagctccctccctctatcgtgttaaaaccggctatcatccgcagcagagttgtcttgccgcatccggacggtcccaaaagggtaaataattccccgtttcgaattgttactgataaatccggtatgaccgtcacattaccgtacctttttactgcattttgaatcgtaatagttacactcacgtacaccaccgcccatttttaggtattttgtatataatatcttcttttatattaataatcttatacaattagtccaatctattctacctaaaataccgctcaaaagggaaaaataccaaacacaagttaacgtttcgtcctcgttaacctgcacgctccccgcacaggtcaccgtcatcaataaaatgcagcaggaattatcatcttcctgctgcatggatcagccgctgtttctatattacaaaccgtttcatttctcctgctgtttgatttttcccacatattccttcgggctgcacccaatatacttcttgaataccatattaaaatatttgtaatcgccaatcccgcactgccaggacacatcctggactgccgttctgccttctctgagcaattctaatgctttctgaatccgaaaacgattcaggtattcaataaatgtggttcccatctgctttttaaacttcttgttcaaaaaagtttcactatagtttaaggcatcaacaacatcctgcaataccaatttctcacgataatgctgtctgataaacgcaagcatctctttcaccaccgcatcatcctcactgctggttccttctttgggaatcagctgtatatttttccactcttccttttccttcttatggctcatccaggaacgcctctgcatgcatttttcctttgcgtctcttattgcctcggccaaatcttcccttttcaatggttttaaaagatatcctgtcaccccatagcgtatggcagttctcgcatattcaaaattcgagtatccggataatataatagcagaataatcatattgttcatatgtctgccgaatcattcccagcccgtccagaatcggcatattgatatctgccacaacaatatccggctccagccgctgtatcagcgctactccctcgacgccgtttgcggcctcccccaccaccgtacaccccatatcagcccagggaatggaatagacgagaccttttcttatgatgtcctcatcttccgcaataaccactcggtacatgtgtcactctcctttcctctgctctatccgagccactacttcaaaacctgcgccctccctgttccggatctgaagtccgcttccatcgccatatctcaggtagagacggcgcgacaggttcctgagtccgatggacggcgagctgttatcgtgcgctctaagctgtttccttaattcctcggctttttcctcctccattccaaggccgtcatccaggacgctgatgagcagaacattgtcctccacatgaccgctaatctttatattaagttccatcttcttcctgaatccatacttgatgctgttttcgatgagcggctgcagcaaaagttttggtacaatgcagttcatacactccggttcgaaattgaccccaaagctgaacctgcttccaaaacgacaattttggatgtcaagataacagtacataaaacgcatatcttcctctaacgtaacctcctttttcgaggtatcaatgctgtaacggagcacttccgttaattttactatcaattcctcagccttatccgcatcaaagactaccaggttccttattatttcgagtgtattataaagaaaatggggattcatctgcgctgtaagctgatccatttcaatccggctgttcagcttcaaaagctctgtattcctgtcattcaacgcctggatactgtccagcatgtgattcacctgatatcctacctcggtgaactcatcgtccgtattcatctgaatccgatgatcatagtctcctttacggataattctgatttcactgaccagcctttcaatcgatgccgcattattttctgccatggatttcgccatccacctggctatcccataccaggcagcccccattataaacagtgcgctcaaaccgatatatacggtttcgtttccgggataatataccagagaataaatgattgccgaaaattccggcagttccttcgacacgacccagtatcgggcctgtccatgggtccagctcccatgcctagttccgtaaaatttattactgctgtctgccagacctggtttgctgatatacatgacattttgtctgagatcggtaatcactccgtcaaagttgctttccgacaaataaaagttccacccgcttccggataaaaataaggttatataccctgtgatttccccctccacaaatattggcttgataaacagggcatctgcataatttccccgatcataataaactgccctgtatatatctccctcaccgcagtttctggcattatagcagactgcattattataatttacaagataagaggagagctgattctcgccaaaggaagtaaagagaacttctccctctgtattcgtaatgattacctgattgtgcacatcacagttctcgtcaaaccgtctgaaataatttttgaattcatccgccgccccggcgtcctccccctcaattatcgcttccacagcttttactgtattttcattcagcagaaactcacggttctgcctgtcaaagcgaagaaaaacctcctccagcttcttcaggtgattagaagcgttcagctcatttgctgccagagtggccgaaaattggccggccaggaaaagaagcgagctgataagaatcatgagaatgattctttttgccactgatttctgtagatttttttggaattttccgctttcatctgttcgccgcactgccattcccccctgctctttttctcattatagggcaaagccggccggttatgcaaccctatgaacagtaacttaaaaagagaagatacggtccggggcataaagtcccggccatatcttctcttcatctgttatttaacttctcagtaatttaattaccagatctctgctgcagggcctgttgcgccgctgctgccccgtgatgtgccataatatgtactcagatccgaatatccgtctgtggaaggaagctccagatttaccggctgacccggattattgaaatttccctcaagcagcatgatgattctcaatgtctcgccgtaggaactcatatccataaccatatacatgttcatactcgtatagtaatcatctttatttataacatactctccctttacttccctgataatcattcctacatccatgctgcccagaagcggctttaaagcatcctgaacataggcattcatctttgccggatcagccacatagcttaaaaccctgttttcgccttcttctctgacggaaaggctcttcataagagagggagccaaatcggctgccgctgttgtctgctctaccgatgctatcatagaattcaaatccatcggatatttaatcttctccccgttagaatccatataataatagccgtctttatagaaaacggtagcatattcggtctggcccaggaattccatcgccatatccgctttgtagcggagattccccgacttaatctgatccatcttcatgttcatcatcatatccagattcaggcttaaatctaaatccatctccggatcctgcatcaccattacagcgtgaacccccaagtcacagtccattgaatcaagttcattcgctttctgtgtcacacgttccagcagcgctgccgggtcttcggctgccagggccgtacctgccatcgttacagtcataactgctgcgagtagtgcggtcattaatcttttcatatcctttttcctcctgacttaatatttacattcctcgtactgatatattaagtatatgctttttctatgtggttttcaatgaaaatttagcatttatcagtagatttaactgaggttaggaggacgcgtccggaacggaccatgtccggtgtggtgagggggggctgggctgagtcttccgtccccgtggggaggttggtcgcggaggggaaatccggccggaatgaattgctgcggggaccgtttgcactctttggagtgcgcatcgggatgctaagctcgtgagagacctcgccaagcaccggcggactcccatgtcccctccgcaattgattccgcctacttccccggggcaggttttcgccgggaacggaagactcaggcggaggttttcgcacaccggacatggtccgttccgggcgctgattgtctctaaccttaaatggaaagggccttgtcgcggccactacgtgttaccgcaggcagatatcaaatctagcgcaattctttcataaaggcgcattgtaggcatatcgtatttcccgcacatggaagctcttagtggccgcgacaaggtccaccctccacacttaacgcatgagatattcagcggccgcagtccagtggacggggccggtacacttggcggagtctttcgtcccggcgaaaaccttccgggagaaggagatactgccgacatcttccggcggagccggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtagccccgggggctttgccttcctctgtcttagagctatccctcgaagaagcagtccagccggatatcattctctccggctccgccctgcgaaaacaaaaccacagtatctccttctccagccagcgatgccacccccccccccgggaagaaagactcatatacacaccccaccccccgtccgctggccgtaccggcggcgtcctcacctgcttaactaaatctcaattcattacagggcatgcatgctttcccggttctcccggtacaggcggtcgaaaagcgggcggattttccggtataacgcagtaattgccaaatcgggctccagcagtgtttcgattctgattacctctttcagcgactcaaaatcacggtaatggcctgctccgacggctgccatcagggcgtcgccgtaggatgcccctgacgtctcctttgctatcgcaaccgggattcccgttatatcggctatcatctgcatccacaggcggttctttgtacctcctccggctgccagaatccgcgccggattaagaccgttttccctgaatatgtctatatgctgcgagacggaaaatccgatgccttccagtgcggaacgatacagatgctgtttcgtatgccccagattcagcccaaatatcatccccctggctgagggatcgttgatcggcgtcctctcgcccgcaaaatagggcagtgtgataagtccgccgcatcccggctctattttatccagcccttccatcatgagactgaaggcattttcaccggttaatttttctttttccacacattccgggaataactgatcccggtaccagttttgcagggtgcctccattattcgtgccggctgctatactgtaggtccccggcaccagaaaattattgcctctgacgcggtcatccaatataagcctgtcggtacagcagtaaaagaagagggaggaaccaaactgaaccatcagatcccctggagacagaacgcctgtgctgactgcctccgctgccgagtccccgcttcccgtaatcacgggtgttccctctttaagccccgtttcttccgctgccctgtgggtcactgttcccgccggttccgtcacgatctgcccttttgcaagctgttcaggccggcagacaggctggcacagctcctctatgatgctcccgtccggccggtaaaacggccggaaggaagccatgcccagaaaacgatccaccacataatttccggtcagcttcgccgccagataagaggaaccggtgagaaatttataagtctgtttatatacatccggttcatgtttctttatccagtaaatttttgcagccacatctccggaacacatgggacggccgaataattcctttgttctttcctccccgtaataatcggtaagttccctgatctcctccatacatctggcatcaatcccatataatattgccttgcgcagcggacggcagtctttgtccacgggcaggcagtccgctccaagggcgctggctcccacggctcttatcagctccggactgattccggctttttttatcagggaatttgacagaaagcagaaatcatgccaccaaactgcctccgcatcatgctcatagaatcccggggccggattttccattccgtgggcgatttcagccctggccgccaccttcccatggctgtcggtaatcacgcccttgccggtataggtgccaatatcaatccccatgaaatatatttcatttcccataatagtcctttccgcgttatgaccgggaggaaggtgcggcagcgccaatatttttcctgtattccttcacgatatccattatttcctttacccgctctttctccacataattactgaattttccatcctttttgaacgctgttccaatgcaggctccatcacactgctcaagtttttccacgatgttttcctttgtgcagccggtattacagaataccggtgtcccgccggagacctttttcacgcgctccatcaggccggaatctgtctctgagccggcgctgctgccggacacacaaagcgcgtcgggaaagcagtggaaaattatggattttgtgattttctcaaggctccgctccgccaggtaggtatctgactcagggtttaccttaaacagcagtttgaggtttttcagtcccagctctttttttcttctgagtgtcgccggaatattggtatcggtaatcccattttcccctatgtatgcaccggtaaaggtgcttctgacaaaatcagcgcctgtcgcagccgccagatcaatggttgctatcgggtttgatacgatattgacaccgaacggaacccttatctcctttttaagttcgcctacaatacaccccatagcggcaaccgtcacataggaaacctgcttttcgtagggaaggctgaactcattggcaatcagaatcccatccacgcctccgtcctgcagagccgtcagttcttctcttgccttttgtatcacggattccatcgtatcctccccgccaaacagcgggtcacccggcatagccctgagatgcagcagggcgataactggtttctccaccttaaataagtcttttgtccacatttttttaccttctcctaatatataagtgtagggtttcagtacccaacagccagttgggacttaatcctctcattgtttaagctgtataatgattaggcattggtatgacgacacctcctaggaccactttaggtgtccgcaagaaagccagtcagccagcctatcatttgcagccgttcgatttatgcaggttggactgtccttgtacatgtccgtttgataccccaggagattgaataagcagtgaggaatgctggataccatgcaaattcattttcaggaggtacattaggatgtacaacgctgtcggtattgatgtctcaaagggcaagagcaccatcgcagtcctgcagcccggaggcgtcattgtcaggaaaccctttgatgtttttcacacttcccaatccttaaaagaactatcaaattatctggcttcacttgaaggggatacaaggattgtaatggagtgtactggcagataccatgagtccatggctaactccctctctaatgccgggttttttgtaactgtcgtcaatccgcatctgattaaaaactttggtaacaatacgttgcgcaaggtcaaatctgaccctgctgatgctaaaaagatagcacgctatacccttgacaactgggctgaactgcggcagtattcatgtatggacaatacacgtaaccaattgaaaaccttaaattcacaattcagcttctttatgaagcaaaaggttgccgcaaaggcaaacctgattgcactgttggataatacataccccggtgtaaataaactgttcaacagccctgcccgtgaagatggcagtgaaaaatgggtcgattacgcttactcattctggcatgtggactgtgtccgtaaaaccggcttgaaagcttttacagtgcgctatgaagctttctgcaggaaacaccattatatttatcagccttccaaaccagaagaactgtttaacgcctctaaagagcttgttgccgtgttcccaaaggagacgtcctataagcttctgatccagcagagtatccagcagctcaatcttgcctctgcccatatcgaacagctccgcagggagatgaatgcacttgcttccacgctcccagaatacgaggttgtcatgggcatgtatggcgtgggcaaaacttacggtccccagctcattgctgagattggcgatgtttcaagatttacccatcgggaggcaatcactgcttttgcaggtgtcgatcccggtgtggagcagtcagggcagcacaactcaaagagcaacaaagcttccaaatgtggaaccggcaggctccgtaagaccctgttccaggtcatgaccaccctgctccagaatgccccggagaatgaacctgtctaccagtttctgaaccggaagcgttccgaaggaaaaccttactatgtgtacatgactgctggtgcgaataagttcctccgcatctactacggcaaggtaaaagcacatctgcgcagtctggaacaaaacgaataatcattccgtctattacggctttctttttgaccggctgatgaggcggtcttagagttgtgccataaaatcacttcacaaaaattttcaaaaagtgcttgactttttattagcaggctttcttattttattccgaatccgggcccttttcgtcaacagacaaaaggatgccacggctcacttggcgtcaaggagcggcagcatccttttcataaagggaacttgctgtaatgaattctgattattttgtctcgtcccatactgcgtgaggatgcttgtgccaccatttaaacactaccgggacgataagcagcgccgcgaggtaaatcagaatcgggacaacggcggctatccagttcccctgtacacaggctaccgggacggcggccagtgcgaaaatttcgataacagactcaatcggggtcacgattgcagcgtcatccaatgtgcagctcttattctccggatccacaatgcgcaggagggccattccgattgcagtaacacctgtggaatatccgtatacgtagattcccctctcaaaccattcctgcttcagcagacggggaccaatcaccgtaaagtggaatacaacccagaggattccaaaaagcattaagaggccgaacggtaccgcatactggataacaaccggaattttaatcgaagccactccgaaaaataccagaaagtctgtcgcacagctgcccatacgggaaatgatacggttgtcaacgtatttatccgctttaattccttttaacaggaaatggaataaaatcgctgccaggaagccgacggagaaactcggaacgcccaatcccgtggcatcctgaattgcattggtcagcagataaccggctccggtcgggattaatatcagcagcaggtgccacgccagcgggtcaatggccatcggagaaacagtctcatctcccagaaccggcctgtggccttcgtcgattagtccggttctcatatcgtccggaagctggctgaagtcttttacatattttgtataatttttagtggtaccaattttgattagtgcaattccgccgaatataccggtgagaatccctactgttgcagatgtcatggcaaggtcggtggcatcttcccagcccagattgccgagagtctggccgagcgctgccgcagttccgtgtcctccctggaatcctgcgggaatcagcatgccgaaagccgtattcagttccggagcaaatattctcagcactaccattgaaaatataatcggcaccgcatactggaatgcccatccgatatttctgtagcagtaatagcttccgatgcggtcaaaattcgtcttccagccgccgctgctgaaattgaagccgcgcagtccgatggatacgaatactgcaataatcagcaggccggcatatgaaccgaactggcttgaaaactgcatcaccccgaatccattctgtccaagagccaggccgatgaatccggccagcaggctcaccggcacaaacaggctctgcagcaccctgattttttccctcaatatttttgctataaacaggaaaatacctgcccacatgaagtctactaacattgaatatgcattaaattccatactctcttctcctttcactcccacttttcttttgttaatacggatcaaacatccggattattttcgtcgctgtctctttaccacggtgcatacattccggaaggctcaacccctcgcacaggccctttgtaaatcctgccacataggcatctccggctcccaccgtattgacaatttccacctgtttagcaggctcccggtaataccggctcccgtcataagccaggctcccgtccccgccgagcatggcgattacgagccgtcccgtcttttcctgagttgactttaaaaagtctttaatcgtttcgtcaagcttctcgtaagagaaaaacgcgtaatccagatatggcagtatctcctcattcccaggatcggccagcctctttgaaaaatcatgaatcataatgttattaccgttctttatgtcttttatgtaacgccctatccgtgaccacttttccgaataaaccagatcaaattgttttacaaaatcaagcctctcccggtccagcgtaaaatccgccagcacatttttgtcaaatttctcatgaatccggtctccgtttataatgttcatctgcgcggcagccgtctgccggccgcctttataaaaatgagtcaaatcaaccccgtactttttcaggacattctcaactgacacaccgaatacatcatcgccctgaatggaaaccagcgagacgtcctgtcccagctttttcaggttaatcgcaaaatccaccgcgtttccggtcggatagaaacggttcagtgtatagtaaacatccacacagttatctcctactgccgcaaccctcattttcccatctccctgttttggtcttccatcgctttattcacccataacctgaatgtaatattttctgttcttgataccgtcaaattcggcaaaatagatatcctgtgcatgtcccagaaccatatttccgtccttcacgggaagtacacagtggctgcccgccagcatggatttgatatgccccggggaattgccccctgtggcgccgtaagacgggagaaaatgggcgtgggcataaatatcgtcacatggcaccattttgtccagcttatctatcaaatctttttccacacagggaagtccctcattcatcgtaattccggccgtcgtatgggcgctgatgataaatacgacgccatcctttaccctgctgctctttaccgtctccttaacatcctccgtgattttaatcaactccacttcccggccggcgcagaccgttttttctgtcagttccactttcatctgtcagccctccaatccaagaaatctcatagcattttcaccgtaaagcttccgccttgtatcctcccgcattttcagactgtccagcccgcgtttgatgcgtacaggccgaaaccggggagcattagatccgaacataacctgatcctggaagttgtgatcgagccagtactctcccatatcatgtttaaagaccttatcaaaaaactgctcagcactgtccatatacatcatcgccgtatccgcataaagattcggatatttaatcatcagcatggccgtctcctgcacccagggccatcccatatgggcaagacagagccgaagctgcggaaattccagggccacttcctcaaatcttaacggatgggaatatttgcacagcgtatccggttcccacgaaagtcctgcgtgaaaaacaaccggtttattgtgctccagacatttttcataaatcggccacatcatcctgtcatccggataaaacctctgctttgccgggttcagtttcagacccgttaactgcagcccggtaaaagcacgctccaaaacctccactgcgtcactgcggtgcgggtcaacactggcaaaaccaatcagcatgtccggacgtttatccacaagagtccggatttcttcgttggttatcaccacttcgccgcagcggacagaatggtccaggggtaagagaaccattttatcaattcccgcatatgcattttgtttatcaagcacatccagaggcgaaggccccatcagatggtatcccatttcatcacatctcagcttcagtctgtccttatctccgcagatatcggaaaaaagagccggatgtacgtgcatgtcaattaccatatctttcacctccctcaatatcattacttatcattctataatattatatatcattatagtctttggcaaaaattaatcgaggcaggcggaggctttctctttcacctcgttcaattcctcttgcgtcatatcacagtattcactgttttctgcggtggtggctgcgtcctggacatagacgagtttcgtatctttctgagtaattgtattgaaccagattccctgtggaatattgtaaaccttataaggctccatcggtataacatccatccggcaggcgccatctgctttcactgccgccagcagcaccgcttttccctttaatagcacaaactgctcatcagtggcatgatgcacttccagataacggatattttcaatatcattatttggtttccagtttttaatacacattacccagtttttattgtcatagacacactggattccttctccttcatagctgaagatatcagcgttcattttctcctcctcattcccataggctgtttttcaacagcattaacagtttttattggccaatttattatatatcattatattacatcatgtatcattatgttgtcaataggttcctgcgcaattttcacaaataacttttctgaacgcatcctgttttatggcatatttttgtaactgctcatgacgactgaactgttgcattttattccataacaacgaaaagcacgcttcgcgaacttttcattgccactcaacgataacctgcacgctccgcgcacaggtcaccgccttcaatttaatgacgaggattccggaagctttaaatctcccgaaaccctcgtcattcacggtacaaatatataaatatagacagatatatggccggcctctcggacggcgctctacagttccgtattctcgttgatctgcagggaaaaacgctccccgttaatcatctgccttcccgcatagattggctgtccgtcaccgcttaacgcaacactcctgatatagagaagaggatcacccctggacatatttaacagggcggcatctctggcagaggcacggcatatctcaatttttttcgtggaatgaacgaccgccacctcgcgcttcttgagactgtcaaacagagaattattgtcaaatgtctcatcgagcagaaaggcgtaccggagcggaaaccaggtgctttcaattgccaccggctcgtaatccgcataccggacacgtgaaataagcacagcctgcattcctttctgctgccccaggttctcctcaatctcagcctccggcacaaccagcctgttctcgatcatccggcctcccggctccagtcccatactgcggcacatatcactgaagctctggactttcttaatatctctcatatattttggtttgctgacaaatgtccccttgccctgctttctttcaaccagccctttatctatcagtccgccgactgctttcctgaccgtgatgatactgacgccgtacgtctttgccatctccccttcagtctgaagtttctcgccgggctggtatattccggaaagaattttttcctgaatctgttcttccaattgaacataaagaggaatagccgcttttccatctaacataatatactccgtttctttcagtgctaataactgtagatataaagatatatattattatattatagaaacaaaaaacccagtattttcaatggctgaatagaaaaggtgtaggaatgctcaagaagtaaacgacatttctacacctttttccactctgatttacatctaactcatgatccgtttatacgatagaactatcttctatgatgtctccgtacgaatcaaatatcacattatttcttgctttgcgatatacagtccgcccataaagaacatcctctgaagaatcctgtattgcatgtccgttcgagtcttccagaacatccaagaatgtaaactcattcggataaccatcaaaggccgttcccgttatcaacgttccgtccgctttatgagcagtataaccacgtaatagagtttcttcagttacagtatccccagtcaggtctatgagggttctgccgctgtaaacgactttacttgtagccatttaagcttccctcctacccgatagttaccgtagtacctccagcgggattttcactctcattgtatgggattgctttaaccgtaacctgagacaaataattgtatccgtcatcagaatccggaaggattgtttgcgattccgtcgaaggtgttactgtctttgcctggggtttggcatcttctgtaccagacatggcgccttctacacccagcaaggtaataccttcccgaatgttgtctggaataagtttctctttttctgatgccgcaataccaactttaccagaaccgtcatggtgtccctgcggaatggtgtactcttcatccttagcagaaatcgttccagtcaccgctccgttattcttcatggttcccgtcagtttctgacctcgtacatacgcagtctttccctgaaggatttcagcaacggccgccgtcgcatcggaagagtttacatcatattcgcaagtacctgtgatcggctccccccccttgtcatgcgcggtaaagccggaaagaatcttatcagcggttacggtatcgctggtcagatcgatcagtgtctcgccaccgtagattactttgttaatagccatattctctcatcctctctttttagacataaaaaaagaacggttacccgctctagttgttcattactcgtccttatttgcctgcttaataatctgattcacataggtactgaggcccgccattaaaattccctgaacgattgctgtaaatatagccattgcaatttcctgaccgttccccagtggacacgttgccagaacccaaatcccacaaaggacgatgccagaagcaccaagaatcagcggaatatacttgtccttaattgtctgcgtctgtttcagacacatgccacagaagtacaagacaatcgccacgacgatcagttccggctgcacatagttcataatctgttccatcatgatttttcctcctactaattttcttccacatatgttgatttatggatgggaagtttattgacttccagcatgattttctgtgccgaaccattcccacccattttttcataaggtttataaaggtaatcattgaggttttcatactcgtcttgagtgatccatcctcgttcgatataacacattccaagatacacaatccggtcatgcgctaatccgatgagcatttgagtttttacatctttcttttcgcctcgtttctggatatacgcccaaaacccagaagaagctatgacggcgcaaacaattgttgctaccatttgaaaccatggctccattttagcatcctccaatatttatttgattttgtcggttacaacgatctttttgttgacaatcgtaatcgatttttcaaacaaatcttcatagagacctattaagtttttcctttgctccctggataaaagcttatagaagcctcccatccagcctcgaaacatgttctctacattttcatacgaaatctcctcattcttcaccttgacagcgagcttcttgagctttcttcgcatcgtagtaacccgctttggattgattcgtttgattatctttccggaatccgttaagctatatttgatttgcagaaatttataagtgctggaaatcttcacaatacgagttttcttcttattgatatggattccatactcttctgcaatccgatgaatattatcaagcaaatccaacaattcctctttactcggattcatgatgtaccagtcatccatgtatcttccatagaacttctgactccgtacatatttgacgtaattgtcaatccggtacggataataaatcccaattacctgagatagctggtcgccaatgtttaccgatttctccatccacttttcgcctgtcagtgtggattctggaatcttcctatactccagcttattgaaagtattgaacatacatctggcgtattcttcatccgtcatgtaagaaacatcaattttgaatccatcaaaaatctgtgtcaacagccagtcaataaattcatcgtcatcaaacagctttaagagttcccgtttggcaatttcatgaatgatattgtcataaaacttggaaaagtctccgaacaatatccatccttcatttccatacaaccgatagtatttacggagatgaacttcgaacctatcccgctggtgggagatacctcttcctttaatcgaggcgcaattatcgtagataatatgcttcttcacttctggaagcaaaacttcatcgcataagacatgccgaataatgcgatcccgaatttgaatacttgtaataggtcttactcggcctctctcaaacagcgtgaattcctgcgtcggtccattttgaagggtccgattcatcaggtcgtcttgaatggaaaagatataccgaagaaaattcatcatgaatttctgggtagtttccttccatttgctggttttgacagaaaccttgtaagccctatacaagttgttggcgtcacagataatctcctcgtagttcataaatcattcaccgtgatagcaatacttaccgtagtaaattgcgtccggctttgctatttatccattcggaaaggacaatgtctccttctctgttggttaggcagagaatccggacgaactccattagagttcgaagcgttgttgtagttcgtattgccattgttgttcacattagcgaaattagccgaagaaacgacgcataattagacattaccctcttaactgtgacttgattcggttatctcgttgacgccacttctttatcaatccgatttctcggtcgatagctttaacatagcgactgtaaagattaacgtccacttcgaatatctcaacgattcgttgcaactcttttaaaagctgctcgcagtttactatggctgtattctgataatctcttcttttctcatattcatgcagcgtagtcggatagatagaatttgctgcccgcacgttactggttagcatagaagccaactggtcaatacgatttttgtagttcagcatcaaatacctataccgtgaaaagtcttctgtcgcatcctttccgtgagcatatcttacacgaacaagctgatccaaatctttcactccgaaactacgctgcataaggtcgatcaacatatcatgcaattcgatagaatatgtaatcgcttcaaatttggattcagtccggtcgctcacaaggacgctcatgcgtaatccttatctgtgatctctgtaaattcttcttctgtaatccaattcatctttacggcattacgaacgcggacttcgttccacatacccatatcataataccgctttaccttgtcgtaatttttgctatgctcttccatgatctcttcctcctttacagttcgatttcggacatcattgcaacatattcaatgtctgactgcattttaataaatgccagttcggtttcgggaatgtcccgaagtacaaaccagtattcagcccccatctttgtgacctgaactagctccatattagtatgaatatcgtccttttcaccatcattgatggttaccgaaagaagatttccgtcaaacaccgatttatcaatctcaacggtggaaacaaaattgtttccattcattttcagattatcaatgacagttccatcggaaagagtgatcttataaatcttatcatccattttgattcttgcctttctttagatttttttcctttataacacaaattgtcgtcacctgcgtacggtttttatggggcacaaggcccccggattcagactaaccaatagcgaagaccggacgaaccccactagagtacgaagcgtagctgtagttcgcatcgccatagtagcgcacaaaagcgaaatcagccgaagaaacgacatctctgagccagaacgttgcacgattggaaatcaacttcgggactaccgtaaataaagcaagctgtgtctttcctgtcgtataacggtttacaatcgttgttccatctccagccggcgtaaacactaagcttccgtacatcataatctcatttggaagttccaaagtagaatcaaaccatgctcccgcagaaggataaccatttgagactgcatttgtcagatattcgcggtgggtaaggatcaagctaccaaacgcacttgccgccaacgtctttgcctgtgccaaattttcagtatacatcttagagccaacataaccgccggttgtgatatttgtctcgttcatctgggcattataaagcggcttgtccggcatgataacaagatgaggagtcgtgaatgccgtatcaccacagttataccagtaatcgaagtccacgattctccaggtgtaacttccaattgtccaataatcgccaaggaagaaacctttgaaagtcccattcttgatattggctttctgctcttccgtaacaaccgcgccaagattcttccctctgtaaatcattcgacgctgctccttcggaatgaaagcatccagaatcgcaaagagtgcgtcgtccgcaccaatggctttgtttccctcggctgttccgatcagaagtttgtcatccgctgaaagagcattgatctgcgtaagctccgacagattgacaccggaaataaaatcctgagagctaagaagcttaaccagagactttgcgaggtcgctggcaagaatggttttcgtaccgttgttgccgtcaatcaagacaatattgctttcatccagcgtctggaccttctcataatccgtaattttcatctcgatatatcctcctttacttaatgcaaaaaataacgcggccgtcgatgggctgtccgttgctatccagaatcaaggagctggaatatgcacgcgccacaatcgggtccacgttactgtcaataatagttccttctgatgaatcgagaagatcatcgtagttctcgtatccattgtcataaagcttgttgtacacggtgaattccgtccgaagtccttccgcaaattcttccagaatcttcgtcctttcctgcaactccaatatctggtttgccaggttcgcttccacgtcctccgaaagagtatccttcaactgctggaaccactcgtcaaacaatgcttgagcgttctctctccatgcagccatttcggatgtattattattcgtgtactcgttaaaccaggacgcccataactgtttccagtgagcgtttgtctcctgcatatccgctgtctgagcagcataccagtcgtcccactgtttttcccattccagataagattgctggatttcttctgtctgagcgttgaaccattttgaccattgctctttccagaaggcatttgtggcttccatatcggatgtctctttttcatagaaggcatcccactggtctttccactgcgcaaccagagcgtcaatagacatcatctccaatggagccgttacgaacggacactccgatgtaccaaccgcatttgtaatgtctgcctggcgaatggaagtaaccccggaattcacccgaatatacgctaatggatactgccaacggtcatttgtactaatcatcgttggtttcaccggattggtagccggcgtacccttaatgattttgattgcatttgcgcggaccgattctctggaatccacttccaaaacaaccgcatcaattcgattcagaatcacttccgactgcggtacagtcaatggaagtaaagcgtcatttagtgtccaggtatgattgaaccacgcccgtccgattccgacattcaccatcatgccagtagatgcattcaccatcatagcagtcccgacatgctgcaaaatgccgtcacgaatgatcccgtcaaaaatactggacatttgaattgcatcgtatcgtcggtctttgttctttgagttatagaacccataagtgacactcatttttcttcacccctttcctgctattctacggtaacgaatgtcggatacgaatcgagtccttctttgctctgggaacgaatgaattctgtgacacgggcttttccttcaatgccatattcattcacaatctgtaccatatctcccaggaaaaagtcttctccatatcggtacatcctcgttgtttcaaccttaccttcaaaggatttggttgcgatattttcggccagattctccaaacctctttgagaaagctgtgcgttatactcagcgtccgtcagagtttcattatccacggtcgaagaaacgtccctagcatccgtgtaaagctcccttcgattcaagcctgttccggcaccagacgcacaagctacagttgtagtcctccgatcggctccctctccctctccggcaaccaaagtaacagttttcaaagtcttctttgattccagataattggtattgattacattttcaaatttgggagaaaagatgacgtatggattcgtaaactgatcgtaagaacggtccgcgccagcatagagtttaaagacaaacttgttatcatcggacagcttgattcggaaaccgacatttttggaatcgcacagttttttaatggcatcatacagattatctccggtaaactgtgcatctaccgtcagtccggtaatcgctgggtccgtggatgcctcaaatatcagtccttccacctttcgggaagcgtcagaaggattgatgatattctcatccagcaactttttgattccattttgaaagtttccgctcagaatcgtttgtttccaaatgatacgtcgctccagaatagattccaatgaccttccagtaaccgtgaagtgatttccgttttcggcatcagactcaatctttctatcctcgacaatcatagtctggtcggattctttcagccagagataatagtcgtctttcaggatttcaagaacagaatcattgatgcttgtatatacctcgaaatccccataggcggaatacctctccgtccatatcagagactcgaaggtatcaagcacagaaagcatttttagagacgtatccagaacaatcaattccataactataccccctcaaacgctgttctgttttcgatcttaaactgcacattggtcgttccttcttccaccacataagcgaaaatattatcacctttggatagctgaaaccagtcagaatctttatccaggcagttcaaaatattggtgtagataccgtttcgaagaagcgtaattgatttatcccctttaatggtggagataatgatttcatcaccggcaaccattccggaaccggttagctgctccagtttatccgtatcaatacgcattacctctctcgtcccagtattgtaaatcgtgatatttctcacatttccgatagcatgaatagtaatcacaacgccaatctcagcatcaccagagtaatacaccgtctgctcggtttcgttcttgatctcgccaaattcgattagggattcggtcaaagattcattggaaaaagcgaactcaaacagaggttccaccccatagaagatcgttgtgttggttccatccggaccagcggaataaaaataaggatcgggacacacgatggaaatctgtgtcgtttcatcactgctgaagatgtccggttcgtttgattccacatagccataagtctcacaaatacgattatccgtctcaatgagaagcgttactctcttctttatcggaaagtatttgtaggaattatgccttgtatcttcaatctgcggattaaacatcagcttcagagacataacaatatttctggaatttactctcgctgagttatacagcgatccatcattcgtagaaatttctgtcgtgttaatatccgccttgctcggccccaatccactaatagattgaacagcgaacccggattcctccgggaacgctaattcaaatcttttggattcgcctaagtaattagttacagttactgctctaatcatgtgttacccaccagccctttcatcgccgaaaattggttctttgtctgccgataaatgtcaattctcgacagagccttaggcgaataattgttttgcgtgaattgataggtatttccggtaggagaactttctccattttgaacttccatctcagaaacccggtcattcatcccagtgctgacggacaatgcctgatttctgctaaacagagtattcagccttccagtccctgcttccacagcggacagatcaagaaccggccgaatagtaggctggacatccatatccgcatccacataatctgcaattctggaaataatgtcatttagtccgtcgatagaagatctggcaatttcccgtccggcttttccagccttggagacattgtcaatcaacgcatttatgaagccgactcccgcaaagttaccgattccataaaaacgtttagaaggagaatgctcgtccaattcatcttctgccgcttcagcggctgctgctgccatagctcttgcttttgcttctgctttccatgtattttcactgataccatcacagaaaccatcgaccagatatgagccggcggatttgaactggctataataatctttgatggcggttatggaaccactcagcgtcgtcgtgaaagcagttcggagttcactatccttacttctcacacctgcgataaacttaaccatgcactctctacctgttgatgtgaattctgcatacttatttttaattacggtgagacaagcactgatgatgtttgtgaacgccatccgcgcactgctgtcctgcgatcttacaccagcaatcagcttcaccatggtctgggttccggtcgatgtgaattccccatacttatttcgtattgcagtcaaacaaccgctaacgatgttggtaaaggttattctggaaggactatcctgagaccgtacaccggcgataaacttaaccataagcgtagaaccactggtttggaactcgccctgttttccattgattgctgtcaatacagcctgaaccagcgtggtgaatgttgttgtcagttcggatttctttgcatttgcgccattgatgaaggatgacagcatactcgaagccgcagccgttactttcgattctgcattattgaacgcgttgataaatccggtcacaccagtttcgccaagcgttgtcaatgcggaactgaaagaagtcataccgcttgtatccagaccaaccatcccatttgccatgcttacaagccgatttgtctgagtaattactccggacagcaatgtcgtatcaataccgctgatactgttgtaataattgctgaaatgagctccgaacgaagccatatcgcttccgaagctggcaagtgtcatatcatcagagaaccatccgccttctttgggaagacttttctgaagctcaacaatggatgtcgcagcattggtcgtggtagtaacgatattcgcatctacgtccttcatatagtcggagtattgtgcgaagctcttaccaaaggaaaccaggctcgtaccaaaggctgcaatatcgttgtctccggtaaaccagcttaccaatccacccgtattcggtaatgtatttgccagctcaaccactgctttgccagccgttgctgaattcgtaacagcttccacatcaatacctgcaattgcgtcagagtaggatttcattgctctaccaaacggcactagcttctccccaaacgtatccatgtcattctctccggtaaagaagccaacgacaccgccactgttcggtacagtattcgccaattcgattaacgcctttcctgccgtagcggattccacaatcacatttgcatccagaccctttacagcctgagagaacagcatcattgcttcaccaaacggcacaagctgctcgccaaaagcgtccatatcattttcaccagcaaagaatcctaccacgcctccggaattcggaattgtggtcgccatttcagccatagcctttcctgcggtagcagcattcgttacggtgtcagcatccagtcctcttacggcatttgcaaaccccatcatcgcttcgccaaatggaataagctgggcgccgaaagcactcatatcattttcgcctgtaaagaatccgataacccctccagaattaggaagagttgccgccatctccgcaagcgtccttccggcggtggccgcatttgctactaattccccatccataccagcaatggcgatggaaaaatcacgcatagcttcaccgaagggaacaagttgggtagcaaagtcgctcagagaagatccgccagtaagccaggaagtcaatccgttcagaatatcagcagcggttagaataaggatcgtttccgccaacgctttcacaccatccagcatggaaggattaagctgtgtggctccttcgataaatggctgcacattcgtcataaatgcagaaaggtctgcgccaatttgagggaactgactggagactccagacatgaaaccgccaacaatgccaccgacaaatttgccaatcgcagtaccgattccctgaagaagatttccgccctcgccgataagccattccaacccagtaatctgagccagagctccaacagccgccagaaccaatgccaattccgcgatgactgcacccattccaagaacgccaagcatagctccaggcaccaaggaggcaacagcactgagagcaagcataatcgctgaaagcaaaccaattccggcgattcctttgatgagtacattcacatcaatgccactcaaggcgtcgattaccccgtcaaagaaagccatcagtaactctactccggccttaatcaattccggcagtttcgtcgtgatagcctgaataattccaatcagaatatcaaatagctgctccacgatagtcggcgtatgttcgaccagagccgaaaggacactgtcaatcaagacaaatagcccatccacgaccgctggcacagccgtaactagagcctcgactgcggcgagcaccaatactgtaaatgcctcggcaatagctggtccaccatttgcgattactcctgctagagaaaggattccttctccgattgattcgaacaggagcggaatcagactaagaatgctggatactgccaccacgagagacgctgctcctgctgctccagatactgccaaagcagaaagtccagtagaaaatgcaagaatacctgcacctgcggccagacatcccactcccaatacagcaatggcggccgaaagtcctaaaatagctggggtcaatggtcctaatgcaactcctgcaacgccgagaacagtgaaagaaccagccagtgccaccaatcctttagcaatgctctcccaggacatatttcccaacgactttagaactggggtaaatatcgctaacgcagcggacaccgtaagaactgctgccgcacccggaagtgcagtcttcatcgcattaagcgccacaacaagaatggtcatggaacctgcaagggttactaatcctctggcaatttcatcccaggacattccgcccatatttcgaactgcttcgccaataatgagtaatgccgcaccgacctctaccattccagtcgctttcgatatcattccattcggaagaagattcattgcaactgtcacagccgccagagaaccagccattgtggtaagaccccgtccaatctccccccaagacaagtttcccatcttttctacagcttccccaaacacaagcatggcggcgccaagaattgtcattgccgtagcggtggaaactacatgtttcgcattagctgtcactttggtaaatactgccagttcagtaagaaccactgcaaccgcagatagtccttgaatcagttttgaaacgtccagatttccaaacgctccaactgcatccgccagaatgttgatggacgctgcaagaaggaccaaacctgttcctttcagaacacccattccatccaaatctgtagccctcaggaacaatgccagttctgtgcaaagaacgccgactccgattagacctttagccaaagatcccgcatccaattcgcccaaatcttcaactgctcctacaagaactcggatcgctgctgcaaatactaccaaaccggcagaaccttttatcagccccttcgatgttttggaaagcgctgttgcggacgctaccagaatagcagataacccggcaacaccgaccaatcctttaagaagctcatcccaatccagaccggataatttctgaactgctcccgcaagaataagaacggcggtggacattccaatcatcgcaatggtcaactgtcccattcctttgattgctgccccgttcatgatcttttcaaagatggccattgaaccaagcagttcaacgaacagaacactcaaagctcccaaagacgcatttagcttctcggaatcaactaaagacaatgcaacaatcgctgcggtcaggattgccatagcgccggcaattttcagaagagttccagctttcagatttgactgccatgcttcaagactccccttaactccatccaaaatatctttgaacgaaccaagaattccaccaccgttttccgtgatttctgatagagaatcgatgaacttcttcactccaatcagaattgcagaaaacaatccggtattgattaagtctaaaatcgggtcaaaactcgcggtatcaaatgctgtgagaattgcttccccaaggttcccaaacgcatttgcgacaatggaaccgagcttcgatagaactggagccgccttctcgacaatcccaataatgccctcgaacgccttctttaccagttctcccaattttacaaacggttcaaatcgggtctgtaccttatccgcaaaattatcaagaccgctggtatcaacattcgcaaactcgccgaaagcatcaacaactgtttttacaaaagtctttactccatctgcaattggtttcaggaaattcccgattccttcgatagctttattaaaggcatcggaagatttaatggcttcatcgataccaacaatgaaatctccaatactggctgtaaacccaagaatcccatctccggccggagccacatatccgatcaaatcggcaaatccaccaaccagtgctttgacaccctgaagcccgatatcaaataaagcgaatacccctttgaatgttctcttcaggttattcgctgtttcttcacctattttgaatttttctgtgagttcctgcaatccgacggtgagattgtaaagttgctctcctgtcatcggtggaaagacttccttaaacgcctctcggataggctttattactcctgccaaaccttcaaaggcgtttcttaccgattcgatcaaggcggttcgaccgccaaggtctttccagtcctgcaacatcttgtttcttgcttcggcagaagcatttaccatgttgccaagagaattgctgacctcggttaaaagttcttttgcttcttcgaagtcaccaataataatctcccagctttgcgtccagccagattgaactgattctttcagagtgtcccataactgcgtgaatgtctttaccttagtggctgcgtccaatgctgtttgagccagttctgtaatctctttagcctgttcttcggtatatccctgtgcaatgaggtccgcctccgaataagccccggacaactgcgtcaaagtttcggtcagaacctcggttgtcagccatccgccttcggttagagatgctcggaatgaaccgtacttctcaatcatggcgtccatattcacgccaaagtgttcggccgttctctttaaagcatcctggaatagctgaccgcccattcccgcattcacaacggagttccagtcctgcaaactaaccttacctgctgcaatcgcctgcgaaagctgatacatagcggtactggcctgataagcgttagaacctgaagcagccgctaagtttgcaatacctttgatcgaggttactgatttatccaaatcaacgccggccgctgtgaaagtaccaatattacgggtcatttccgtaaaattgtaaatcgtctggtcggcatatttgttcagctcatcaagagccgcatttacctgatcaatcgttgtccctttactctgcgtattggcaagaatagtctgaaccgcattgatttgtgtttcgtactcctgaaatcccgtcttaatcggatcgatcgtcagtgcagaaacaatatttttaccagcatttaacgccgaatttgtgatgtttgccagagccgtaactgccatgacttccaacgctgagaaccgcatctttaccgtctcaactgcgttggaaagcggagtcatgttgcagttttttgctgcggcattcacatcttccaatcctttggaggcacctttgagatttaagcttttttcgagcttttcaattgtcgatatactggtctgaacattctgctcaaactgcttgttatcgaatcgcatttcaacgactctttcgtcaattgtcgtactcatagcttagtaacctccttccatgcgttatttgcgattttgtcaaaaataggctggatagcaggattgatataatctcgcccctgtacccagccgccgtttcgagtcccatgtccgtactgcaaaataacagcaattggaactccattttgaacatttgaattatggaatgaaatcgtaactgaaccttttcgattctcgatttcgtaataccaggaattcgccgtttccccagaatctaccggtgttgcagacgcaagggcggctactccctctttaccaaacttatccaggtctccaatatgaaccgcttcttttgctctttccagaaagcgggtcaacttggagaagtcacccttttgtctgaaacttatcatggtatgtcctctttaaatccgagttgcataatccagggaaatccatccggcaccggatttcagcttaccccatccagcatcggaaccggcaccgctcttaacttcgacaatggtatatacgcctttcggacaaaaaccattgtttccgtaattcgttccagggcctttgcggatatacaaatcgggaatgtctacctgaaccagaaaattacttgaaggtttttcttctgattcgccggaagccgcacctttataggtacaataagcctcatgaacactgatccatccggcaccggatttcagcttaccccagtaaccgttctgaatttcggtaatcgtataagtaccccggtcagtaatcattccattgattccataatttgtcccggggccttttcgaatgttcagatcgccgacatcaaccttatacagacctgttttgtaagttttggaggtactgtccgtcgtacttccgccaagctgagatgttactcgattcgcaaggtctcccagcctggaatacagccaatccccaggacaggctttattagcaaaccatcgatgaaccgtgaggatcatctcgttcgacttcggactgtaattcagagatttatctttgtcgccaaaccagattagttttgacttgccatttctctggcagatatcaacacacaaagccaccagcttctcatatactgcacttgtcatggcatatggatcggtcatatcactggcgcactcaattgtcacagcccgctggtcatttgcgttactggaagaacaccagcttctgtttgcttcgtctacacacagaacaactcgtccatcagtcccgattccataattacaggacgcttctctactgggactggtaaagcagccgccaatagattctgccgaaagctgtccaactacacaatgcggagtgattcggtcaatcgaatgtgtcctagctccgctgtggtttggactttttaccgtacaattcaccaagctgctattactcatagtaatcaccctttcgtgttccatttctttcttcgagccgcgttcaatgccgcattccgcttcataatttccctgcggctatgcttcttcggcggcctgcttttcacatcgcatactcttatcagagtgaacaatttattgagatgccacttctggcattcaaacggaatgttcaaagctatcatccagtaataaatgagttccgccgtaatctgctctctgctaccctgtgtttttttctcttcgaaaaaccgggtggcagtcataggaagtgcgatatacttatttacctcattgatattgctgtttgtcagatagttataaacttccggatttacattctgcgtaagagtcatgcattttacataatctatagtttcttccaaagttttttcctgctttgtcagaaacggcttattccatctcgattcccattttgaaagagaaacaagagaatgctccaattgcaaggtctgagcctttgtgtaaacaaactcttgcttcacctcatcccagaattctgtggatggtattgtgattcggagcatctcttacatctcctttaactctgagcgtttgctgcgattgcaggagtcgttgcagaattaccaacattcatcactgcgttcacaaagtctgctgctgccttgtcatttgtaaccagttcctcgaagagaacctcgtaagcaggggattccataaaggatctggaaatctcttcggacttcataaagcgacggccatcctcactcttgacaccgtaagccttcttaataaggtcctcaaagaactccataatctggccgccatcggcaccggcgccaatgcttttgagctgcacgtcatagccgcccttaacacttgtctgcatctttacaatttccggctttgacaggtgaaaatagaaatcctcttttctttcaacgccattcagatcgatatagggaatagttttcttaagcataattttttctcctttcaaataaaaagaagccccgcacattgaatacgaggcttcctatacatttacattattctgtttccaaggtaagtccggaaagaccataagtcttagtgacactttcctcgttgtgtgtggtagtcaccttaatgctctgagtatccttattcttgataagaagtacgatgttcatgtcgtcatcgagagtaaccggtcctttggtaccgcctacaagttcaacaaccgtttcagcttcagccggctcagcttcaatcttgagagccagataattgcctgactgttctgaaacattactgctgaaatcaacataaccatcgacatacttcagagtgcctgtcacctcatcatcggagacaaccacatcactctgtaattcatttactgtttttccgaataaaacagcctctccgtcttcaggcttaacggaaaggctcattaagggaggtcttcagcagtcagaagctcgatcacttcatcgggaagcggaagtcttggatcaacaccgtcgttaccctcaggggtagtcgggtctttaccatacaggatttcttccagagctgccagattctctgcattaaccttagtggaatccagggtaagaattgcagttggcttcagcttcttaccgtcgatcgtcttcgtaatttccacgggagtcgtactgaattcccaagacagagcgattgcctctggactgtcattcacagaggtatagcccttttcagaaacagaagccagacaaccatataccaaatgcagtttatagccgtagtcattggaatctacatcgttaccaagaatggtacgataggaaagaccgaaaatcttcctgctctgctggcccgcaaagacacctggagcaacttcgacagagccatcacactccgcaaattcatccggagaagtataagcctcaatcgtaccgccgaaatcctctgcggacatcagattcagatatttgatgttatctgcataaatcggggaaggctctgcaccagaagggctctctgtcaccgcactcagaccgttccaagcaacacctttgttatactgtccacccgtctgaatcgggtagagaacgccatggtcaacgccagtttcatagaagcgttctccaactttatcccaaacaagtttactcattgaattattcctccaatctcagaaatacacattaaaaatgtagtgattcaggttatcttttttgaaatgccggtcaaaccggctcatcggtaaattcgttactttctgcaccagggacgtatccggatctttgtcaatgacggtaacggcatatcttcgattagacaaatataccccgtcatttgcatacgtcttgtcaatatcgtcaaggctatatacaatggcggggtaattcatcttaatagattccggaggctgaaaataacatcggcactgttcgccttctatcgggcaagataatatctcacacaatagcttgtgaaacaggattcgtcgatcagtcattatatacacctcctaccgtcagaatcagacgcggatactgcacttcgacactggaaatcttccactttgctcccatgaactcaacataccgcattgtgtgaaaattctgataggcaaaaggatcggccacaatgctgatctcattggaaatgttgatgtcgtcattgagcttatcagaagtctgataccgactggtattccgaatcaaatctccgaaatactctcgctcagtgatttctccatcccaaacaccaggacgaacatcctttgatactgcatagccgattttcccaaaaaactttgccattttgaattttctcctttactcggtctccaaagtcaatccggtaagcccataagtcttggtagcggaatcttccccatcgttcaccgtcaccttgatgctctgagtatccttattcttgataaggagtacgatgttcatgtcttcatcgagcgtaaccggtcctttggtaccgccaacaagctcaacggtcacaattgcatcctcggaatcagcatcaactttcaaagcaagatagtttccttcctgctcagaagtattgctgctgaatcccgtgtatccggtaacatgcttcaatgtaccggtaatctcggactccccgacaacaacattctcctgtaacgaatctactgttttcccgaacagattggctcccccatcttcgggactaacggagaagccgattaagggttttccgttacatcctcttcgatcgcaatggcagagtacactctggtcagagcaccggagcatctggtctccagaagggacttctcctggttaaagtcgatatcgaactgcgtaaagtgggtgacttctccgcccttcgtagcgcccagagagtagtcattcagattcgtgatgatagcgagcagcttcttggtcttgctgtcatccgtcttacgggtcttgccctcgaactgctcggcagtgagaatctcacccacattgaaggcagacgcaagctccgccttggaagcatagattctgcggccgttcatatcacgggccagaagcatcacattgagcatatgcggggtaatgtacatatccggagtaccggtacccttgtaatgttccctcgcatacagaaccgcattgatcatagcttcagcgtaaatataattttcaccgaagtttaccccggtgttggtaccctgaagttccttctttgcagcttcaacatccaaatcggcgtgaatagtgtagaggtcgtcgtccgtccagatgggtctgatcttatccggatcgatcttgccctcgtcgccgtcttcacggccgtcacccagcatcatcgcaatggccagctcttcgttaagcatcaggcggtcgatgtcatacaggtacttcacgtaatcgaagtcggtgatgtcaacgatgtcatcgcgatgcagagcattcttcacataaacagtctgcggatcggtggttctgcgcaccagcttgaaattaccggcctgctgcttctcttttcctttcttgtagcctctggcgcgaagagcgtcaatgccacgaatgtctgtctggctggttctgattctggaaatcgggctcttatgtacctttctcattacattggtaatccagccctggtcgttggtaatgagttcaggtgcgcccggacgtacttcctggtattccgggaacaggctcgtcacgtttccgtcgccagtctgaacaaagccgccgctgaccgcatcatgctgaaggccattctgctccgcataaagctgaagagccgtctggaaagtaccaacctgactggtcttcgccatcttaatgatgtcttcctgcgcggaatgggtcagaaagccaccggtctcgtttttcttatcgttgtcaaacacgttatgcttcatctcggtatttcctcctttagaatcgtcatcatttttatcttcgggctcatcggtttccccgatagcctgtccgatcattgcataaaccacatttttctgcttttcattgagggtattaaatacctgctcaattgtctcgtcatcttcctcaggcttttcttcagaagtcttatcttccttagattcggatttctcctccgtcttcttttcctcggatttgtcgtcctcttcggcggaatgataaatcataatgttctcgtcatatccgataatggtacgatcttctgaagtctcgccgtgagccatgacggaatcaatgaaagctccaggattggctccggccagaacaaggctcagttcgtagataacgccatgcaccacattcgctccggcctgtttaagctgaccggcacaaatagaaagcgaacgaacgtctccatgctgaaccagcttcttcgctgcctgtccagattcgctgtcattgaaactacagtaggcataaacgccctcatcacgattttccagcactccatgaccaagcacacaattgggatcagaatgattatgtccccaaatcaggggaaccgtttgtccattctggctcttaaatgcatcccttttgatagttcgaccatcagtgcaaagaagatcgtttctagtggcccaaccactaaaatcgtatttctccattttgaaaatcactcctttttgtcagtattgcgcgaaagctgcattgctacttcctccgtttccgcttcttcaccgctttgtattcggaagctatcttgtcaaactcttgctgatagagctcctcataagtggcatcaaggttctcttttgccgctttataagcttccctggcggcggtgacagcagcctttaactctgtactgactttttctctttctgatttagcattcgcagaattatcagccctctcttctttagcgtcttcggtaattcgcttctttttacgacttgcggaagtcctcacctcttccttttcagctttcgcctgctcactcaccttagctttatcctcgctggcatcatcacgaagctttgcgattttctcgttgcgctccgccactcgctttgccctttcctctttggataatccggaaggaatttctatcgccatcaagcgttcaatctcagcatttttcttttcgtcaatacgctctttctggtcttcagcttcctctccaatatcctccaaatcggattttttacgagaatcaaccctactccttcttgacgaagattcctcggtaagctgagcattcagttcctttaatttggctgagatctgctctcgggttgccttagcctttgctctcagttcagcaattttttgttctcgcttttcctgttcttcttttactttttccttcttctcgctggttatctcattttttgtataagcccagatttctttaccttcatcattgagcttcgttgtagaacgacgccccttaagttctctggttctcatataatattcatgagcttttaccgggtcataataaggagatgcataatgttgaaggagctcgtcaatatccattaggtctcctcctcatcatctgaaacatagtttcctataatttcatcaatctccttttcaagaccatcaagcagctcatttacgatgctgtcgtaatctgctccggaatcactttcaccagattcgacatcagaaccctcatttgaaggctcagattttgcctcgctgatattgctattcttcagctcatcggctttcggatcgtcagacggcttcatgccgataatctgccgaatttcgttggatgtcataatctcgtttcttgtgaatttgtcagcgatttctgacagatcagctaccggtacaagcttgaaggggtcacggaagaacagaattgattgcttttgagatctggccgttttggtaaggaacttacgtttcatttcgtcaacgattgctgaaatgattggctcaatagtacggttataataattcagcatggtcttctcgtctgcggaaccatccaatatgctctgagtgatacctaactggctgtaaagcatactcgtcagatattcaatctgcttcatcagattattttccacagaacgattcaactgtgtaatccgctccgtaccatcggtatatgcaataccatatttagaaccggccaactggcgttcaatctcgacacgcctcttctcagcctgttgacgtcttgcttctgttttaattacatagggaagctggataattaaatcaagtttccccgaactgctctgctcatcgaccacgtccaataaattcagcttccttatcaaacgctgcatcgttgagttcggctcattgattactgcataaagcggattttcaataattgcgactgtatctttgggaaccacaatgtcttcctttaatccagtccgctcattataaactctcgctttaatatggctcggaaaccattccagaatctttccagtgcgcattgactcgattttgtatgagcctgtagtatcaggatcgtcatccgtatcaaccggaataatcgccacacagccctcatcaagcatggataaaacaacgtcctgaaggaaagcacgtcccgtctggtcaatattggcagataaattcagacagtcatttaaccctgaaggaattttctcaaggaatctttcagagtcatccagtcggacgtgttggatgctaatcgaagcgcaatccaatgcaatgcgattatatacagaggtaacaatggatctctcattccctcttgtaagtcttggacggtcgggtctgtatgaatatccaactcctatgtctcgatagaaacctgttgggtttctatttaaaaaagcgttccaggcgtgtttaatcctggaaccgattgaaacttccattttgaaatcgtcacctcctattcgaaagcatctcgattaagcttgaaagcaacaaacgcatccatcatagctgccacggcatcaatctttgcgtcatatcgctttttcagcaatttacggttcccgtttgtatcttccataacgatgcagttccccatcgcaaaggtcataagttcttcatcaaacaaaagcatccgctcctcggaaagtttctttaactctcccaaaggaacggattctgtcttagcaccctgtataaccttttcaattccaaacggaccattttcagaggaccatcgttcaatgaactcttttgcattgtatgggtcataccccaagcatcgaacgtcgtatccaaattctgcaatgtggttatccaaatcctcgtagacttccatcatatccaggacagttccctccaggacaatcaggcttccctcatccataaattgatcgtatttgattcgcattgctgccggaagtttcattagagtcgatgaggaaatgtagttcctggttttcactccaaaggagccattcgataacgggaaaaggaacgtaaaagcacagaaatcgtctccctgtgacaaatcaattcccaaagaacagggcatctgccagtagcttctcttcttatgaggaagggtttcttcatatgtgaagtaataggtgtagccctccatcggcaatccaaatctcttagccaagatatcatttctggccgcaggtgacttctccgctctttctacatcaagctgataagtttcgtagcttaccgtcttaccgatattaggatttgcctttaaccacatatctgggttgccaacttcatcaatggaatcgagtttataccaccaaatggaaacatgaggattgacgtaatcacctttgagaatgtccatcaactccattttgattgtgtcgccggctccgtttctcaccgttccctcagaactcgtggcaacgatgatgtaatcatccaatttagacgcaccctgctctaaagcgccaaccacatcttctctggtatcgccggacagccactcgtcaacggtggaaatcttaggacgcaatccctgaagctttgcgatggacattggacgtacttccagaagcgaacccgtaagaaaattttcgatgccctttttggtggaggccagtttcattcgcttcgctttagaaccagtcgtattctgcaaagaaccttccgttaggaatcggaacaacgggcctctcgaccgggtaattgcagttcggaagggcgacatcacttcatctgcctgcttcattgtaggagccgttgtgacctgatgcgttgtcgaggtatcgatatttaatccataagattggacgcaagtatcatataaagatttagcagcccctcgtccaacaatgagatattgtttctttatcagacgctgcttaattcttttatttacatatcgaccaccatgtccatctgaacttggctcccacacacttcgttcaacgaagtagtaccatccataaagctgctcgccccataatttgaaagagtccagtaaattcaaatcagagccatctgtcaatgttagttctgattcgcaataagcaatccatccttcaacggcctggtcatcgtagtaaataccaggattggctatcaggtcgtcaattcggttcatctccatagagacttctttacaaaccggtatctctccccttattacggcatcccgaaacatgccgtagtatttgggaacggcagtgttcgataatgccataattgaatcacctacttgctggttgctttcttgataaccgcatcaatccccttcgtcatgtatttcgatacataattagtggcagtctgctttgcagcattggtcagcacgtcctgtacaaactttctgccgacagaaatttctgaactggtaagctgtttatactgcttttccatctgaagacggttaatctttgaacggagttccgaatcggacatctttttaacctcgtcatcggaactgttcttctttccacttgctctcgcaagctgttcaggagttcttcggacaccccatttcatcccaagaatcccatgatgctgtaacaatgcttcattactcattttgaatctccctcctttgcgatatatgatgtcaccccatttgctgcatttccggtttcgtaatacgggacttctgttaccacaatatttcgatccagaactttattctcggtatccagcatctgagattggaacgcttttggtgttatcctgtactcaccgtcgtaggattcgtattcttcagatttttcctcatctgtttccgcggcaacattcagtctccactctgcctcggcaatcatcttttccatggatgctatcacagcagaactcaacggcggatcaaatatcagccttaccttcatatgcatgtaggactttactagctgtaatttcgtctcatcggaaatgaattctttccacgtagtgcttttatcctgaatggagaatcccgatggtggaccaacgccgagttgcgtcaagatcataaataccgaattgatatgtatgataaggtctgaatcgaagtgttcgtactcttctgtaatacccagcatctttttaattgatgtaagtatactttccataatctctataacctcctctccatcaatgtttccagggacatgtatcgtttctgcttcgaacaacgggttctgtgatgagaaggctttcatctccatagtgaatggcattatgcgttgtaagaattgttgagattaggtactccggatttaaaaggaaattgctcctctttaaaatatcctcagcggaaatcggattcatatggtgaatcagtatctttccatatatctcgtggccttccattccaaggtcacatccgttatctctcataatcacaaaatcacgaacggccttccattccatagaacgataaaaaatctgattcagatatcggtcaaacccaaaagtgtctgcaccgacaactccgcccaaacgaagatactcatatcgctctttgaaagtctttaattttgataattccgaataggtcctaatcatcgtcgctaccctgtccactatatatacgaaacgcattgatggcgtccttatagagatccttgatttcgtcggtggagtcgattgctctcacttttgcccgcaacagattgttctcttcctccagtcgctctttttcgagcttctctctggaagaacccagtttcagatagtgagtaatgacctgagaagaagcagtcccttccagcaattgcttttcggccaggtcaacagccagagaaatcatctgaagctcccttgcttccggagtcaaagcaggacgaatcttcttggaagagccagttgattcagaactctttgcttttctagccatttactgcctccttcccatctgtttttcaatagtttcataaaagttttccggcagtatttaaaagaacccacaaggctgactgtaacttttttaccgaaaggagaaaaaagagtaaaaagaaccacagcttattacttagccaaccttatgagctctgttaaatactgccggaaagtaaaaacattctccgaaaaatacccccggggaattttcaaagaccgccgcgatgacggagggggtgcgatttttactaccccccccccctataccatctgatacctagatagccaccgcatctcgcgtaacttttttgtaaatgtttcggaaatcgtatcttacgatctcatcaattgctcgttcaacttccaagtcattctcttcatcggagagttggtccgaggttctggcaattctaccaagatacgaacatgaatgataacctttttcctcatcaaacagcaaccatgaagtgaactgttcaaatggatcgaaaggattgtcaatggttgtaagcatacacttcttcgccatttactttgttcactcctttccattcagatacttcgacacagtagaactggaaacacccaaagctgctgctatctcagcagtgctatagccagaagcattcagcgccgcaatacgattcacttttgcggagctaagggttgttgttgcacgaggggtagctctctgtctgactgtatccatgtttgtattgttgagaatctgggtaagcttgttctcgctgatggcgccagcctgaatcgcttcccattcacgatctgtaatctcgacaggggttctcttggcaccaacagcagtacgggccgcagtaagagcctgttgattagccttcttgatttcagcccttgtcatatcgggattgtctttcttcttagcggccacaatagaattcgccatggtctgtgcctgacgctcgcggggggcgttctttaaagccacattaagcttagccatgagagaatcaacctctgcctgataggtacgctttgctgaagcagagtaggctatctttccagtattaaccatctccctgcgggcctgattagctagggacttcatggtatttgcatagtccgcatatgcttcctcttgaggggttccagaagataaagtacgggcgtctctggtttctgccatcttggtactcttttgagttcgtacctgggtctttccgttcttatctacatactcctctcttacactcttccagctttgctcgccagtttctttgtcaataatcgggcttccttttctcttcaatacagaagtctcagacttagcacgagaaattaaagtagaagcaccaccataaccatcatcgtcctcgtgagcctggtacttcttcttcaaagcagtgatgccattgtcctgttcgctcttcttatagtccaacttatgcttctctgcatcgatgacgaccatgctatggcgcacagctcttgcaagctcgtcctgagtcgcacctttcaaagtcatatcagtaatcaagtttgaaatcttacccatttctgtctgggtattcttcataaccttaatcttctgaccgctgctgttatagtaatcgtcacctttcttaacagtcccataagacatcttaggatcaaagccttctaacccctttaattgtggggtagaagtaatcttcactctgctattggaagaattacaagggattaccatgacggtatcgccatcgaagtcggctccagaaagacggtcggccacttttttattgataccaatagcgtccgctggcgtattcccaagaacccttcttccttctggctgtttattattaacagttaagatgggaatctcgaaagttccaccatgcggataccgcacaagggctacggtttctccgttcttatagttcggagcatagacctcgttgtctttgatggaggttaatggtagaatgacttgatacttctgtctgggaagggcggctgcctgtaaatgaacagcagcagcatcacaatcatcggcaaaagatttcaaaagaacctttttcactgtcggatttgtaagggaacaaatctcatcaaattcggactgcttatccgcggctgccagattcaactgcttctttatcaaagttctgctctgcttcgacaggaactgagacggaagcttgtcggcccattcaccccaatccccttcttctgctcgcttattgataagggaaagctgtttcttaccattcttatcatagtaatagctctgccctcctctggtatccgttggattatctgggtcgtcgattccttctttgattaaggaaccaaacggattatcgggatcatctttgattggcttcagaacatccattttcggagttccttttttcttattggtgttgaacataacatccacgccatcaggaaggtcatctgaataaacagccattcctttgatgtagtgtgttccatcaaccaagattcggacctgagcataatgggattccccaagagacagatcatcaacccctcttcgaatctcaacaacgccatcctttaattccccaccatcctctgcataacgaatttgaagtctttttgaatccatgcttttcggatagacaaacttcggatcaaaggattctccatcgtcatgagagacataatctttcagagaattgatattctcaaaatcataaatttccttatgctctgttccaggcgggcaaattactcgaagcgtggttttctttcccggatttgttatctgatccactcgaccaccatagacaggatagccttccatctccaacatgtagagcgcttcattcagtttctctttagaaattccaagctcacgttccacaccggcgccgacatcaatcatgcctttttcatcaatctgctttttgataaactcagcagtcgttttggcctgattcatacgaacctcggaattctcattcaaaagcgaacggacggaagagtcatttgcaaatcccatttcctttgcaatttcgtttaaactcaatccatcttctcgaagagattttgctcttgcaacatcaagcgcacgccgttcgtcttttgctagagatttctgcgtacggtattgagtggtggttaatcccatggcttttgcgatctcggtatcactcataccctgacttttcagttcgtccactcgactcaaaaaatctccgctatgctgataaggattttcaccagaaccccacggataacgaccagaacggcggggcattccataatgcattaaaatttcttctgcaatcggattcataatttagccctcccgttctttgattttgttgattactttgtcgaatgtgataatcttgtccatgataggaacgatagtttcagccgttggattctcataaagaatctggttgttctgatagatccgaagttccatctcaatgtcggccggcttgattttgtattccaaacaaaaaagagcagcgtatatttcaagctgctccatgtgcgccggaatgacgccggtttttaaatcgtgaatacgaagcatacgatttcgaaatgcaattgcatctgttgttccaaagcaattctccgaatagaaaagtggctgttcaggaatcattttgaaaccaatcgcgtcattcacatacatattcaatgttttctgagacttcggaagtttctgtccaagcgtaatacatcttgctgcgaaatcgtgaagctccgtacctttttgagtcgcaaggaattttgagtacgattctgcaactttggattcgtcatagttaatccagtgatatttgcttgcgccaagaaaggcgtgttgcccttcaagagccgaatgcttgttgaagatcatgtaacacttcctccttattttcgggacaaataaatcttgagaatgacatctcattcattcgtccaacataatattcttgatttggttgtttcttggcgcgaacacttttcttacattctaaagtggcccacttatcgttatagagaatcagcaaatcgggaattccctgaatgtgactggaatccagttttgttacgatgcagcctttgaacattcttttcagttcctgaatcagtttgttctgaaattcgctttccagcataagtgagcctcctttctccaaaataaaagagagaatggccattttaaccctctctcttcataacagtcgatgtatttttcgcgcgaaaaaacaaaagcggacataaaaatagcccatacctaaatcagtaggtacaggctaaatgatttttatatttatcgaggaacgactttcacagggttaagaaagaacactccctcgttctcactaaatgattgaatttcagcagtcacatgtatatttgatccaatgcttatatagtctggaagatacaaatcctcgattcccattccataagtatttacatcttcaaatttgaaaataggtccgggatttactgtattctcatctacataatcacccgcagacaataataaatcgtatcttgtatcattatctccgtgatttaccaaataggtaatacacgcatcaaactcgataatttgatttttatacttttctgcaaattctgagtaaattggatcgagttcgttcgttgccgacaaaactgccgctaagtcttcattattctccggtgttagattttcttctggaacttcgttagtggactccgtattttcagaagtttcattttcaacttcagaggattcctcattactttctaaatgtgagtttttatcttcggtagatggttcttcctcgtcagggaatgtgtgatatgaaaccactatttcaacatctggtaaatatttagaatcggtgctgaacacagtatcgccatcaacagagacttcatccacctctccttcgtcatttaaccatccagttactaaatcaccaagaggctcttctcgtatattggtaaaacctgcttcctccaattgtgagactatctcctgataattagcgccgtcataatcgtttccaccaaacggcatgtgaatttttccgtcgtcctcactgctgcatccagataataaaactgttaaaactgctacaatcgccagaaacttacgtttcatcttctttctcctccactcagtttttagggcaataaaaaaggtgcggccccaacaagagacgcacctgaaaaaaatgcatctcccattgttgccacacaatctcgctccgtttaagggtatgagtaaagagagaatacactttttaccaaaatgaattcccttaaacgacgttgcgatatttgattgtgtggcaattacagtatagcacagttcaaaaataaaggaaacattttttcatttactcttgactttttctttaagctgtgatataagcctgttttctcaggtcatcgtagatcatcttcattccgtcctcgaagtacactactatactcatatatccgaacggacgaaaatatacggatgaccgcgacaaccttggataaatcgacttgaaattttcatacaagctctcccaactaatcttgctcatgatttcctccatttttactcgtggccaaaaacccacttttttttcgctattactatatacttttaaactttctatcataatagttgaagaaaaaaagtgggaaagtgggctttgagcccgcaaacccgcataaatactgggtttttgctgaccaaatcggggttttaaaagtgggcagaaaatgggcaaatggccacaaatttgaccaaaatcgtccgaatccttctccaaaactctccacatttttcaaaaagcccagataaaagtggccaaagcccatttttcaaaacccaaaagtgggcgtgattttcacccactttcaagctttgtatggacgatttttaataatttcttctctgataaggtaagtgttttcggacagtcggccggtaggaatattgcttaatgaaggattctcttcgagattttctcaaagacataccatatcgagccggagaactgagactctttttcttctctttctctggtactgataatccgaatgcctcagccagagcgtctgccatctcttttactttcacggcaaattcgtcaaacgctttgacaagagcatctatagtcttctgccaatcatccataaataatcacctccaaatccgtccggttcgtttatccttaataacaatccgctcttcaatgtggaagtcggacagctcacacagcgtaaaaatggtgtccagtagtttgtggaaccgatcctcttcctgctcaatgtttctcagtgcttcgtaggcagtcggatcagaatacccctcagcattttttcgaaaatcgtttttagtacccatctcgtcctccccaccggaatgaatcatccatataggttgcagacgagttgaccgcctttaacacaatcagcccaattagactcacgagtccaacgatacaagcaataactcccattacacatttcatgttgcttcaccctcactttcaactaatttcacaccgccatattcccacaaatcctctttcagcttttccatgtccagttcaccattttgccagcgttcgtagtattccagaaccagctcggtaaacttcggaatgcgcttcgcataggattttgtccaataatgatccatcagcacttccagcggcagagtcaggagcagaaccatcgcagtgtttacggcatcatctgtagcttcctgcttgattcgctccagctcttttcccacctgctcacggacggctgcatcgagctgcgctttcgtgagattgtatgtagcggtctttgctttctgctctaatttctgagcacgtctcctctcggctcgtcccatcatcctcatccccttcataaatccagttcgttttcgcaaagaatagtggtactcccataatcagggaaaataaaaagaacgttgcatcccattcaatcgggaccgacaacgctccaagcaggataatcaggacggcatagattttattttttatcagttttcggctccacatagttactctcctttattctgctctttggcgaggattttcgcctcttccaactttgcgtatcctttggctgaagcacaatgttcaatacatttgcatatccgagcgattaacgcatacaagcagaaatatgccagtaaaatacaaatcaaggtttcaataaaaatcataaataatacctctctttcaaatgctcgataacagttgcaaataattcatcggtcgataaattcagcgattccaattcgtcttctggaataacttgcctagcgttgattccatcttttttaatggtaatataaatgccgtccatgagaagatccgctttggaaaagctaattgtatagccgtcgtctatcatcgatttaatggttccaactaaattcatagatttatctccttcccgtcagcatataatttaactctttctccaataataatctccgaatatggtagtgttttaatccacttgcagaattccacccactcatcaagcttatgttttttccgcataggatagatgccggccagcacttcgtaattcagcataaccgttcgtttctggttataggaagatggaagaatctgaatcatctgccaccaatgatctttatcttttgtttccagatattttgccctacaagcatttaacattcttaacgtcagcataaaaatattttgtgggctgaacgcattgtatggatcatttggatcttgtagcaatggacaatcattatcgtccgccgcagacatcagatgttctatgctaaaatcctcgaccatgaaagctttttccgcaatcttatgcattgtcgagcaagaattcgcaaccgtccctactttataagtgtcaaactccttccaccagtaaagcggagcggtaatatctacatagaccataatcattctccgatacttcgcatgagtcggtccaccggctgcaagtcgcatcatcaaatcgtggtctgctttaccaagctgccaggaacgattaaatgcgtgggtgcaatattcctgatttgcacagttctcacatccgataccattgtccccacctttgcagattccactatccgatttctcccaactgttcatcggattccgcattccacggatagcgtgctcccaacccataacctctacgttttcaattttaatcattggcttctttctcctttcgcattttctccatctctgaaagcatctgattctcttcatcgcagaagacaatttctgacggatcaactcgtctgactccatctgaaaactctacaataccaaacatcttgctaaatattcccgccggagctccgcccattaacggactagcctccaaaggttttgaataatattcccatgcgtggaaatatccaagcttttcgccaacttgacaaagccttgttttccactccatttgcatattaagtcccgccattacaatttctcctttctcgctccagcttcacgtcgatagctttctgcaaatcttcaggcttaatatcaaaaatggactccaggaagttcagacaaatataagcatctgccatctcttccaagagtccaattctgtctccgtagccacgaacctgtttgctgatctgctgctgaagctctgcgaattcttccattgctactgtacattttgttttccatggatatttctgaagacttctccgaataatccgccgccgttccttttcggaaagctgaatattgctttttagtccttgaataaatctattccgattcattgctatttttctcctttttcagattctccagaagctcatgatacatctttcggcgcatctcatactcgcaggaggcaatctcaataaagtccttttcgccttctctgaaatatcggttaatctctacacgttctccatccggcttaatcgcatagagaatcccaaccgtatcaaagtcgccatttttccgatcggtaagaaactcctcgcaatacacacggaacggtttgctctccggaaaatacggcatggtaatcgggaatttttcttccattactcgatctatcaagccactgtggtaggatacatctggattatccaagttcacaccacagaaacggttgacatctctgtacttaacagagccgtcagcatatacatacttaaagagagaactcatccgccgacactggtaatttgcaatctctccacgaagaccacttcgatcagaaatatcgctccaggcatcttctgtgtcttcgatagaagtgagcggctttccttcaatcaatcggtttaagataaactttgtcatgctgatgctaaatccgctgtgaccatcttcacaaagactccggaatgcctttaatgcactttcgtagcaagcacatccgtaatcccattctcctggtttccgatcaggtgcttcgtgtttgcaggcaatttctacttctctttccgcccacaattccatactggatttctcatgtgaatcgggctctttgatttcagattccttttcccaataggagtcatagtcaccctttataaaattcctggcatgagctatatcggatgtatatttgcattccacacccgggcaagtatctccgcaacttttaccatcacaaagataaagaacatcagctactccgttttccagaggccagatattccgatcatctatgtactcattggcaaatatctttctggtatcagagccaaagttttcgatgatttccggaagattctcattgactgcgtcaaatgtcagttcattttctttgcaccactcaatggccttttgaagcatgtcatctacacgacaagtccaaagaatcagcttatctccgttcttttgtcgatcacgaagatactctatcaactcttcattggctgagccgatttccggccatttgttctcgcataaagtcccatcaaaatctactgcaataatttttgctggtttaagattcatatcctttttctcctttccatagtggactcatcccttatgcaactgctatatccaccttgtggccgccctcattattgctcgaccctctcccaaaaattccaaattattcaagccatttgttatcgatataatagaaaccgaaaacacagatcccaattaagactatccaaataatccagaatatccatattcctaaatcagtttctaagtattctacggtctcgtcaatcctcatgtttttataaaatggcgagttgtcagctatcgtattattagacagttctgtaaatacagtcccggtaaaatttaaacctaccccataatatttataccgaatatgactggattctttaatagtgtctatatactcttcttccggcaaatcaattttactaactgggaaaacatggtttaaaaacaatattttgttacatgtctgctcttcactaccggaataatcccatgtccaataggtttccgttgtgtagtaagtatgagttttaccattcaccgtttttctatgtgaaacccgacgagtatgcattgtgtatcgttctttaacctttttgatatacatatattcgccgccaatttcaggatatgtaaccgtatcgacagcttttaaatccccgtacacaaaagcgtttccgacattggttctcatcccatactcaaacagttcatgcgattctatttttattgctttgttatatttttcgtttttatccaagtgataatctgaaatttttccagcaataagaatcccaatcagaagcataacagctacaattgatatacttgccaatatttcccgttttgtaatttcgaaattctcaaaatcaaaacttctacgcttacatcttctcatattttctactctccaaataaattctgtggagcgtcaacaggagcatcataatcgagataggtatagttctgaatctcatatccgagaacatcgagaaaaactcttgtcgggaatttccgtatatatcggttatattctttaacctgcttattatagttactccgatattctgcaattaaattttctgtaatagaaagttcattcattagctctttataattttcatttgattttaattcggggtatgcttcagaaacggcagtaatagcggtagtgacattttcaatgtcaccagtggaacctctaccttcaacaattgcagtcaatgtctcagcttcgtatttatcgtactgcttaacacaatcggcaagattataaaccaaatctacacgccgcttttcctgaaccttaatatctgaatcagcggtatagacttgctcttccaaggcaaacgctctattctgagaactctgcacaccaaacacacataataaaataacagccactataccagcggctacgatcaaggctactttccagttgtttctaattgttttcatactcttttttctcctttattcattctcaactatttttatatttttgttaatataatcgaaaaacccaaatttgtactcgtcttcggatattgctgtcatttcttccatttcagagctaaacaattcgatattagaataaactttcctgatctttgaatttgttgtaatatcgagaaaatatacgtgagcgaaaaacactccgtttttagagaagatgtattcaatttgtccaatccttttggtcttctcttctttaaaataagtgttctgaaaattatcggtataaaagtttgccatttgagaaagtaacgaattttttaattcactttctttttccacacgttttttgaattcttcaatattgtttaaacaggtctgtagagcatcgttaaatggattttgtggaattttcatgatttcctccttcttatccttctgaacttgtccacgctttttatcaccccggtattcttgttaatgatgcggtaatagaattcggtctcttcaaccagcatccagtctttacaattcagataatgagcagataaacattctttttgctctctggttaattttttcggttgcttcatgtggttttctccttgctaaagctggtcttctttgatttgggaaatactaacttttgataaagcgctttggcctcttctccctgataggcgttgataatttcgacttttcctttcttctgctttccgacaatcagaacaccaacgtcttttccatgggaaaaatcccaactcacaattacgctatctgttgatttcattcgccattacctccccaagcttattttggatgcggcttaaaatatcctccaccaattttctcgtattgggatgcagttttatataatttttatgctcttcgtaccaggagaaaatttccagcaaatttcctttaaaccaactaaaggaccaccaatcgcaaatcatctccagaatataacagtagggcatctccaaaacgatttccccttcttccggatcatcattgatcaatacccaatgctgccaatgatgaggatttcgatgaatatgtaacaaccaggcttttcgaaaatcctccactactgcataagagcgatttcctccataaaagtaaatatcataggggccatattcatcaggctcagttttggattggtcatgtgcaaatacgatattatgctctgcgccactgccctccgtgatctcaggaagatttttctgtaaccatcgaaatcccgcttcaacgttagatttatgctgtgccaaatatcgatcatattcgtagctcattttttcttttcctcccacattacaggtttgtgagaattgagattatacccataatccagacattcattacatggatcgattttctctcccaattctttatgtttacaagttttgcaatactttttaaaatctacttccaaatattcttcattcataatcttttcacctacctaagctgccgttttcgatggagtattcccagaccattttacaaactttgtctcgttgaaatcctttttatccttcaaagacctgccgatccccaaatcaatcccgctccgagatttcaaatgatagtaatacagatccttgaaaggcgtatttagcctgtctattcggcccgcagattgtttcataatcttataggaatagttctgagagtaaaatataatggtgtctgtcttgatgcagttccagccttcagctccagcattgtattgaacaagatatacccagctttttgactctggaatcggctggtgtttgtgaccattccactctgcaatttcaaaaactccatcgtcctcataaatttgaaacaatccttttaaaagctccaattcataatcgaagttgtaaaatataatggctcttggatgtttctctacgatctccatcaaggcgatctgccgagactcatccgtatttacaatttttcgccatatatagcaaagaccagcagcatttgtaatcggctcgtttttaaatgggtcccatctggttcgtccagcgtctctgtatttttccacatcatatttgacaaacacatcttcgtgatgagaaaccgtctggcgcttgaaatccatgtttaccaggattcgattcctgagtcgaatcagtcttcctgtattcaaatatcggtcaatctttgggtatttactgaatcgactataaaccacatgttcttggatgaattctgtccgatttttgtaaaacccatttgcaatgaataccggaatataatcctgccaggtatctcccggagttgcagataatagaatccattggtttgatttggtgattttcaggaatgccttcacccaagccccggaaccgattactctctgctcgtcaaatataaagaaagcatccttcacatcggcatacttcttgatattattccaggaatccacgataacctgatttgaatataaattaacatcctcgtgaaccgaaagaaggaaaggcgaaagatcaccctcccattccatcgtgtctcgctttctggctgttgtgatgatgtataagtcctttgggggatcgtccatcgcaacataatcctcaagtcccatcaaacaatctggatttcctccattctgaagatagtaataagccaacgctgttctggactttccgcttccaacgccgccgcacagaatacagccatttctcattttttcaacggctgctatctggtagtcatatagtttaacggccattcacgtctatccctcctcacatactatgaatccatcttcaacctcagcccgatattccagaataccatgctcttccaagtttgccttcggcccgtatcccaacaacatcgtagcaatctgctcgtcggtcttttctttttcgtcacgataatacgaccatagagcttcttggactgattttgtgacgcaaattttccgacagtcgaaacaagttttatccgttatctccgccggtatttttcgagccacattttcatagaatttggtcaaatcacaataacagtcttctttccttaattgtacagactttaccatactacccatcctttcatatcttgtgaaacaatcttctcatagcccacacatccgaaaaatacattacggtaaaccaatagttctctccgttatcgtccgtagacattggttcggtaagcgagttgcctaccttgatgtatgcggctactccaagaagagaaagctgaatgtaacacatcaaagcaacggtttcatcaatatcctgagtagcaaccagaacatgattctggaagttcagatttaccttttccaattgctttctggcctcattaactgccgcaatcagcgttgccccggcaccacagcagggatcgttaatcgtgatatagcctttttcttttacgatggccgccacatcttcttccgttacttttgccatcagctcacagatatgatagggggtaaagaactgactggtcgatttgttacccagattcaattccataaaaacactgcctaagaagtcctgctctggattatcttccaaagccataaccacataggcagctaattccggaaacaatttttgctcctgcttattgtattttttgataatcttcaaatatcgtttttcccgttcttcatagtgggatttatccatcggattcgataaagaacaggcaaacattatgataaaatcccgccatacatcccatggcctgtgccggtaagtcaactggtgaaaagcttttagaaactctttcctgacattctcatttttcggcagtttatccggctttggtatgtccattttcttaggctgtggcggaatgcttgattcttgtttttcgctgtttacttttggtttaggaacagaagcattgattttcggtttcgctgtggttcgcttctttttccgattccaaaattccatactttttctcctttctcagaaatatagggctgtttcctctagccttaggacatttaccttgctggcaatatcaggcaccctatccgtcgcttatcagcggaacggaatttcttccggaccttcttcctctgcatacttctcggcaaattcatcctcttcgatggtgacatacatcgttttcagataagccttgatgccggttttaccgttcacttcccaagaatacggtcgaatcgtcaaatcaacattgcgaatctccgcataatccagagtagaaatggactcatcatcaagaggtgtcttgttccgtcttgtaatcataaccacctttggcggaatgttctcaaagctgaccgccacctggatataatgggttggctcttcgtccttctctctcggtggtaaaactcttacgttccaaccatcatttaagagcttttcagcctgttctggatcgtcaataacaacacaaaaatttcgattaccagcccgattatacttagattcttctcctctgaaattccgaaaaataatgcgagcgttttcaataacaatattaggtacatttttataagccatgatacttctccttttctttaattaaatggtaattcttcgtcagcgtcttctgggatgttcataaaatcctccatcctcggctttggaatataaggatcatccgatacaaaccattcgaagtcaccgtatttggatatggtttcaactgcattatctacaagcttgtcataataagaacggtcaatagaatcttctttggagagttctttcaccatctcagattccagccaccgatacccctttgagccagtagcggcataatatcgtccgtctttttcacgcataagcagaccgccgccagccccagatttgatcggacagaactgtccaactcgtccaatgaaaatataattgtggccttctgcaatctttggattcagcgactggcaagtcttttcaaacgtcgtgtcggaaagcaatcccttacgataatcactctctgcttttgaaaattctttttcgtattcagacacatcgggaagtccttcgttcatgtccaaatataaagcgctgcttaccgacttggtttcgcacatatcttcaaagacaatctcttctccgctgaaaagcttcttgaagacataaggaatctggaactgagttcctgtggccgtccactttccgtctttatacttggcgatatagacagcgtcatttaccaggcacatccggtcgtatgtagcctcgtgctcaaaggtgtatccataccgtttcccataatccataacaaactggataatttccggtgttgcatctggaatcttgatggaatccgtcttaatgtgggcaacagtaaagccccgttcctgcacctcgtgcttgaggttgatcatgaacagagctcctcgtttggccacaatattatctttatttctcggatcacggaacggattctcgaagttggcagaagtcaggccatataccgaattgattgccgtcttcaaagcatttgccaaatcttttgccgtcatctctccgtcaataaccttctggatatacggagtcagctttccatccagcatatgattgacttcatcccaggcttcgtgtttgatgctgactcgtccttccacaatatcccgaaaggcccttgtaaatttcacaccaaacagaacttctgcgattgcactgtgaggatgcatagaggaaatatccagcaatgccacatttccatacataccaggttccgcgtaaacatagccgccttctccaacctcttctcctcgatatgtcgattttccattttcatacttgtatccaggaaaatatggaagaaggcttccttcgtcgccatgcgtttgcgccatcatttcaggacacgcttcagccaagaaagattcggtttcttcatcaaggtaatgtaccggctccgccagatttcggtaattgaactgatcctgtggttttcgctcgttcccaaatataatcttctgggtcagcgtattggtcgtgtcgtttaccgtcatgccagccaaatccgccagaatctgtcgagctgtccagtccgccttcaggtagtggaatgccgcttcggttgcgattacatcgttatcacaatattcagctaccttggtccacatttcttcgggaaccggttgatcccaaggaagcccaagctcctgatgatggattcccatctcaatctccagcttcttcaagctctttttatttccggcagatgcaaagtcatacacatccgtataggaaacattgtaggcttctccaaagaagcaattgggacttccactgataatcttttgcgaaaggttatagagctgctcgttcgtataacccatgagtctcgcatacagaatatggttatcatatcgacggcagttgaacccaaccagacggaaccgcatcaattcctcaatctcggtcggcgtcgggttaatcatacggacaaccggctttccctcaccctcgattttccagtttacaagaaacaggttcggaaatacctcaatgtcataaaagaccagttttgcttcttcgtttctccccgctgtggaagggtctgctgatttaaactgcatcttatttaccagcttgatacagtattcggcctgatgcgtactgtttgcagcaaatgccaaaactgcgttccgcatatctgtcacatcgtaactcaaatcgctggcatatgcgtcctccagtattttgtagataaaatcgatactaggcttagtacccggatgaatttctttattcagatttcgtttaatcagtgttctaagccctttctcgcttttaatcgcttcaaaatttaccattttgtcttctcctttcgtcggtaaaccagagctaatcgttgcgataggcaaatcattacacttcgtaagttttcttcgtaatgaacttttacctgtgaacactttcacttcgatatggtcgtcataaatacgactcagtttttttacatctcctgtgtaaatataatgaagatgaaccccctttccgcttttacttagctctgcataagtcgccggccacttgcttgcttcttcaacattctgttcgaaggatttgtttccatccttatccggaatatcaaagtcgattactatgtggttttccgggactttaacataatggattttagaagtgtccaaatcggacagcttcgtttttaccttgtcccatttcatggaaggcgtctccttgtcggttgcatactgcgccggacaatcagagcacacctgatcgaaaatggattgggttgcattaaactgcaataatgacggtttctcttccggcttttccacaatggtttcctcttcaaatttttcagtccggaatccgatataataacttcgcactcttgaaccgtcctccatgttaaatcgctctttgtaatcgtggaaatagttcttcagctcttccttaaaaactctctgagaaaatggatagcctacttttgcctcgtcacagtaggtcttatacatctcccaggcagccttcaaggttgtaccgttttcccgtttgaacacatggtaggaatcaatgatgaagttatagaaatcgttggaagctcctagcattgcaatgggaatataatcgtcatataaaccgggattgttcaaatagacttcctggcaatgatacgcgatcgcccccaattcgaattcaatctgtttcatggttgccttgtattccttcggactcagcttattccctgaaggagacacatcaatcagtcgtcgaatcaaaccagattttgcatccgtaattttcactggcttgttggtacccatgaacagaaagcatttgaaccgattggaataggttgatttaaacttctcattcacggtcatcaactcatgggataccaaactgtttaaccgggtattgtcttcaattctcgacagatcgccatcatgctgaatcgccacaagaggattgctcttgaacgcctccaatgcgaatgaattgctggatgagccaagagcttttgcatcaaagaccgaataatatccttcaaagagctgctgaatgatattgaggactgtggatttacccgttccggcagctccataaagaaccataaatttttgcagttttttcgattctccgcacacaatagaaccgatcgcccattctatcttttgtctttccgtttccgagtacagagtagacatcaatttgtcgtaagcagacaaatcaccagcctcaagcggatattttagctttttactggcgtaatcttttttatcggtcttcgtgttggagaatatcagtttgtcatccagcatgtggaaagaatcccgcatttgtttctgacaatatttatgccaggaatcaatcatcccggattccgcatcccacatgtgaagaactttaatttcagagtcaaagcgctggcggctttcttctgcgtatctatccagttcacggtcaatgagttgcaaagcatcttgttcgtccgtagaccataaacctcgttcctcaatccagatagcgtagaagtcaccacctcgaatcatcagatcggagcttttcttaataatgaacttcggatagatttcaattacaccacgctttgtactacgtgtggaaatcatcaaaaagtcgatcatctcattttttactctcctttatcgcgcttcaattcctctattgtcgattccagtttctcaatcctctttttctgctccacacggtccagctccaggagaaccagattaactgtcatgataagagccaacgtgcttaaattccggttatagcgggcttgtttattcagggatttccgaatggaccggattgccgtctccgaattgctgagacttccgaaaatataattcataacctcgcacatcttacttttttcctcccttcattccattcagaaaactggtaatcgtctcaaatctccaatctttctgattatgataagtgaatataaattcctgaccatttttctggcggatacgaatgctgtttcttccatttggaaaccatacatcgatccgatcccctgaataatcaggaaaatagttttcaaaccacttcattacttcgctgtgacccatagcaatctctccttctaagtattttcgtccaagtaccagcacatctgataccagatttcaacagaccttaaatcgtatcggctgtgatttacggtaaacagcccaccgtcaccattgcggctatacttccgatccagaaaccgctggacaatgtcctcgacataatcccggtcaaacttggaatcattcatagagccaaggccaagattgacaatcatgttccagaaccactgtccagttcggttcccaacgtccggatcgtccataatatgctcttcacaccgaatcgcaagcgcaatcatcatttccagcacactgcacatccggttatctaaataggtggagatcatggagctgctgtatccgttttcgtaaccaaaccgataccttaaatccactccatcctccgctcggtttccatccattggaatactgtaagtaaattcaattcgatgcaactcttttaaaagcttccgatacgacaatttctttgaatatcttccatcaaatacaagctgatacatccagttaaaatatgcatcattaagctcgttctttgtcattattcctccactcgatgcggccttgtctttgcgacatccgagtagtttctctggtcaagcaggatttcataatcgcactttaaccgatcgtttcggacaaatacggagtcatcctcatattcaccaaaatggttcagggactcctcaccgacaatttcatccacatcgtctacctcttcatcattttcatcagccagaactttgtctgcatagtaagtgaggctgattttttcatattcttcaaattcgccgaattcctctggcgaaatgacataaggcttttccacaaatgcctctcctttcttttcctcgacactcctggaataatccgtatagccctctttctggatgatagatgcataatttttgaagtccacattactctcgtccttctgagttctgtcttctgctactttaagtccatcgcaaaagccttctacgaaaccttttccaatttcccttgtggcataagccgccttcacagaatcaatttcctcctgagcaatcaactcatatttccgtttcagcagtttccatgtgcatacagagcccatccctgctccaacaacgaatgcaaggaaagccattcctttactgctcatcatcttcctcctcgtttctgattgtcattacggttattgctaaaccgccaaaaagaaaagagacactcaacagaatgcctcctatgatatgtctttttctcttggtatccagaacataatccagtaccgatattacattctccagtccgtccatatcagtgctcccttcctgttgacagaattgcgattccaccaacaaagcagatgccagacattgccgccaacgtataagataccaatgctaaaagattacgcataatgattctccttccttattcatactttgaaaaataatggttcccaacctggaacatcggaacaccatatgcgctatattcccctgccgtgaagaatacaacatcataattagttctcgactccagttcttcgtagacgagttcacaaatatcctctcggacttcacatctgtccactcgtccgttccacatggacgaaaactgatttggctgataaatcacctcatacacagtatccggaaaatattccgaatccatccggttaagtactgtatcaataacaaggcgttttccttcttcgcattcaccttcggcttccgccattgttacgagggcgatcagctccacgtcttcccgagacattttgggtattgcttctgttgttgactcctccgtttcctcgactgcaatttggatagattcctcttgcgaaaccgtaataactggctcagtcttttcgacaacgattgctttggatatcgcagcaacgtcttccccctctgagtggaactcagatataaagaaggaagaagctattacaataccgcacaatatcgggaccgttattactttgattaacctgtgcataaattcctcccaaataaaaagctatccctaagaattacagtaactcctagggatagttataaattttccctcacatcaaatcccagatgtttccatcgacattgaagtccagaaggattgcctgatcgaatccattaacgtaatccgaataactcagattatcggaatacaggccgaaatcaatgtaattatctccttttggattttccggatcataaacccaaccaacaatctgaccggcttttgttctcggaagtccaagcatttcataaacctcattcagaaatacacgcttcttcgctttcagcaaatcatttgcataacgctcctgagctttgataaacatcagattgtattcattattgctttcccagtgagggttcaggatagaattcccattttcatcctgagtgtacttttcaaaaaatctggcataaccgctgatatctgccggactcactacgaagccattcttcttaactttcttttcttttccggtttcctcgtcaataactgtttcgtcaaactttttggctttaagattaaatctaagttcacggtcaacctcttcgccaaaccgttcgatcacgcggctgcgatactctttgaatcccttatctatggccgcataagctgctcccagagccacgtttctcttccgaaggatgttgttggatgccagaatactggtaatcgacaatgcaccgagtacaacagaaggtccgtacagcttggcgaattttactccagtctggatataaacaattgccaaatcctttttggcatcctcgctggaatactggtccttcacggattcgtcttcttcgcatttatgaattgcttcgacatcttccttcgtcttatccagaatttttcccacctttgtcgttgctttacacgccattaccgcactcgtaaccacgccgataacaccggccacaacgagaatctccggactatacttctttaattggaaactggtcttgctaagaaaaccgttcatgctctttacaatctctgctttcttcatagttatttattctccttttttcaaatgatcaatcatatgttgtgtgtaccaaaggattttctccaaatcctggattccgtttttcttcttccaacggcaggcatatttgataatgtttgcggtatcggtagcctcaatcccttttaaatcgaaggtaaaggcttcgatcacatcaataacttccatacctgtttcagaaatataatgatctggatgggataccatcttgtcttctgactcatacatcttgcattcctccttttacaacggcgtcggtttaggcagtttcaaaatgtaaccgtcccttacccgaaccgccctgcatccggcaatatcagtccatccgtatttattggcagcatagttatcattggatacgtttgccagatcataaagatctgcaacactgaccacctcatactgtgcgataatctcattcatagcgtccaataccgattcagcatccccacgagtttcaaataagagttcatcatattcatagctcgtccgactcttcggtgccgtataatctttctttccgctgtcgtaatacttctgataggataccttggatgctgtcgaattctttttcgattttccagcctctccataaagaatcatatcaatgccattggttactatatcggaaattgccttttttatcgccggcacgaggacatccatgacaatataagatttcacattattgacatcttcagaaatgaatacgtccgcaaacttctgcatttctgactttttcttcggctttaccgtcccagaaatcaccttttctacacgtttttcgggaacgagatctttctgctcctcctttgatttgtgggaattcggcttatattcctccattaagttgtctcctttccactcactaaactaatctttccaggcaatataatctttgtacccggaagtcgattgttcttctttttaaattgataggtaagatttgaccttgccttcttttcggagaccgcccgtgtagaagcagtccaacgattagcaacgcagttgtcaaattccatcactggtccgtcatacaaatataaattcatcaatgtcacctccggataaaagaaaaaagggaaagcaccttgttacaggtactctccctcgtgttgaaacacatttttctctttaagcttcttcggaatcctctttctcgttctccacgattggctcttcagaatcatcccactcagcgtcgataatccgctgctccttctgggctttgatcttagcaatcatcggcttacccacatacttgtagattacaacacctgcaagtacggctaaaccgataccagccgcaaccttaaacccttttccggaactcgctttaacgacttcctcagtagttgcctccataacctcttcgttgttcatgatttcattggtttccatgtttattctcctttcaattcttgaaaatgtgtgattcttctttcattaaagacgctgtatttttcgcgcgtttataacaaatttcggtaatcatatcgtggagctactctgtaatcaattaccaggcagggagttccatcgctggctaattgagagctgaatgataaatcgatatatccattatcgacattccacccaagttcgtcgccgagttttacactgtccagaccaatttcgtagtagaagtcattcagggatacatacatatcatccagcatttgccgattcagttcgcactctgctttttttattttttcaatatcgcttttgaagtatcttccggaaattgcatcatagcagagcgtattccccttttctgtaatgattacctctcttgttactaccggattcttttcaaccttatccttagcaacggcatctttcactgcctcatttttcttctccccaaacatctcaattacttttccctgatagtctttgagtgcggattcggataaggtatatgctgttgcaagtgcagcatttctccgagcattcactgagctggctccgatcaggcaggcaacagagagtgttccggtaatcgctgccggaatataacacgcccatgtcgttttcaccatatccattgcttcaagcttttcggctccgatttcctcttttctctcttcaatgagaatcagtgccttaggcgttgctcgtacagccatgaccgtcgttgtaatcatgcctgcaatgccgattccggtaagaatctccggactatgctttttaatcgctgttttcagtgacaaaaagctcttggctatttcttttttcattacttccttcccccaattcccaaagccgttttagataattcaagaaccatgtgaaacgcctcattttcggtaaagccggcttccataaaccgatccttcaagttcttcatctcagaagcagctttagcaaacatctctttctcttccagatttttgatctcctgtttgagaagcttaatctcgttttctttctcagaaatctcttcctgtaaggactcttttgttaccttgttctttggattacatcctttaagagtcttataagacactttgttttcacggggcacagggcccctggattcctgcttaaccaaccagaattccggacgaactccatcagagtccgaagcgttgccgtagtccgtatagccacggccgaccacaacagcgaaacaagccgaagaaaactcctcttttgtagcatttctcagccatccccatgcaagctgatcctcaaaacaagcaatccgattcttgcagtctttcatcaaaggaagctgctcatcgatatccggttccagatttttgttgtcccattcgtcctcatgaccaacaatctgtccaacggtcggaatagtaagtccgtaaatcttgtcacgcaattcctccggaaacgccataaacagaaccgtatccatccacttcttcaaatcagacttttcaaagccacctttatttgtgtctcggttgttcattggccgacgggtaacataatcgtcaaatataaacatgacgccctcgtccgtaaccttgtgagccgttacagtaaactctccaagctctgccagaggaataaccatctgatctcctacctgaatatttgccgtgtcgatttcctgctttcttaataccttcatgatgtttctcctttcgaaaatataaattgttgtggttataaaataagaccgagaagtgtctcggccgtattttctgctacttgaaatatgtagttgtttgttggttcttccgacatgtgaaggaataactccattttcaatatgaagccttctatcaccaagtctgcttctgtcatcggatgatccataatggccagtaagatttcatcaactgcccacctttcatacgaacgctccatgatagccgatttaggccaattttctccgggttcaaataaatgcccgttcgcataatttaggattttttgaataacttcgtcattcatcagcacttgttccaaactaaaaagaaagagcccttgttaggactcctcttcgttttcatcgtctcttttggcaagtgcctcattaaccttttcctcaattttttcatccattttcttttcgtttacccaatcggtaaggatactcactccgaatccgattacggtaactgcgataccaatggccttgataaaatttttgtttttcataaagcattagcctccttttcataatatggtctgtaatttttgcgaatcattcaaacttgttgactgccatcgtgtcgataatgatacactccaggccatcttctaaagttgatttataattatcaaaatccaaccaataacaatccatttcttccaccatataggaaatatcccaaccgagatcatcgcctccgtctataccctcgacacccaaaaatgacaagtattcatttaatgagcaatcgcctctaatggaaagattccgatttacatgatattgagcatttaacaccgctgccattgtggttctaaaatacttctttgaggcaagatcatagaaaagcaaccgctcactttcggaatccatgtccatgttgtaaacctgataaccccagtcgtaggaagacaccatagcatctttcgccatttccgcatggattttatcatccgcatcctctccgtaaactgttttagccgaattccgatattgcttataggattcattgagcatagcgtatgcactcatcaaagaagcctgtttcttctgattcagcgcatttgccccgaagatacaagcaatagttgaaactccaagcagcgcagaaggaacataagctgatccagccacccggataatttctaatttggttaaattttcacccttctccaactctgcttctttcaacagttttattgctttgggagttgcccgaacagccgtaatggttgtcgtaatgactccaacagaagctactaccgttaaaattgtcggcgatgagcgatataattgacgcccaattcttttcgagattttaactttttgcataatgttctcctttcatttcgtcctattccatggcatataacagatcttgaatattttctccgactatcttagcggcaataaatatagaactgttcttttgattcatagaagcaaagtctttcattttctctgtgaatgaatgagccatcgcttctaaattttttatggacgtttgggtctggggaaaaatatgatcagctacataatttcgaaattctccaatcgcccacaatgtattgctaaccctggtgaactctttcttgtcaaatactggatttggcaaccattcgtccatttcgtacatatcgcatagaatcaaatccaattcatccaagctcaaatttctgaccacctccttaaaatccccctttcttgattgataaaaataaaagagaaccagtatcggactcgaaccgattacctccgcggaagtgcggcgctctaccaatgagctaactgtttctccataataggaattgtaaattttgcgaagtaaaaagaaagagccattgctggctcaatcctcttaatttaaaccgattttcttcagaattttcatgagttcttctttgctcatatccgcatcaatactcacatgtacgtgcgctttctcatctgaaatcgaagcattcaactcgtttaactggatatccacgttatatccaagttttttatgtaataccccttttgctaatttcgaaagcaacatccgtgtaaattttgagctgattttcatttcgtccatcacccttaaactcctttcgcttttaatcagttttccataaaaggagttgtaaaaatgacgtaaaaagaaagagcccttgttaggactcctcttcaacaaacgtacaaaaattatttatggatttcttcaattttttcttttccttccacgtgtcatacatctctgctccaatacatccaacaatagctagtgctgcacctattcctacaccaatcaaagtatctctacatcctctggtgtagcaagtatttgcaaaccaacttaatgcctgaatatcttcatcaggtatgttattcgttttctggatttccatagtgatctcctttcataaataaatctttgttttcataaaggaagatgtaatttttgcggactaaatatcccgtctgtcgaatactgtctcccatcgttcacgtttaatcggcttcatttttaaggcccacatgatctggcgaattgtcacggtcggataaagcccgtccacagccttcgcggaacgcccgtcaaaatattccttaaatcgtggatgcaaatataaatcatccgtaatccacggatctacttccccccaccaggtactctttgttttctcgtcaaaccgctgttggataaccgccagtcccttttccccgatttggaacagcgtgcagcaatgatagaccggatgatcacaaaaatatactttcccgtacatcgataaatagatgttgggcttttcataatggtatcgcatcatttattctccaaaaagaaaaagcctatgccgaagcatagaccttctctcaataatatttttagtcatcaaatagcttacatgacgttttgcaatatggatatggccctccgcaggctctgcatccggctggcggaatatctcctcgttccatatcgagcatttcttccgtccattctacttcttcatcggactcatactcgtaatcctcttcgtccacctttaatccacacgatggacagatataaactccacatccagtcttcggatcttctgtttgcctcatgacggctccacaccgattacaaatcgcatatccgttattcaggtactcaatcaattcaataccttcgggtttgataattttgtggctcataaatattatctcctttcgtttttcgaaagaaccgctattattgtacggtttcttccggtgtacggtcaagagacaaagagctctttgtagcatctcctttccataatagcgtctgtaaaaatcacgcaaaaacgaagaggacatgtataaatcacgccctccccatttctgaccggttaattacttctttgtcggtctaaaacgattgaacaatcctctgaatgttgttgaggtataggttcccgtttcttcaaacttaaatcctttccgcatccagatgccatagaacatcagtggtatgagaagctctgccgctgcaatccccagtctgaaatatcgatccttcacttgctcgtcaagctgagaacgcttatactgctcatcctgtacatcggctttgatctgctcgtccaactgagattttttaatctcgttctcccggacatttgcttcgctttccaacgtacgccggcttcgcttatcctctgcgtccagctcacttttggtttcttcgattctcaaacggtacagctttaccagatcctctatagcctttgatttctcttcgctacctgaatccagagaagatattgcctgaatctccgctgctatctcctcgtttaacaaatctttgacgttttcacccattttagttctcctttcgtgaattcattaactgttccataaaaggacttgttattcatgcgaaatataatttttgatgttgactttcaagaccgcatatcttttcttatatatcgcatccgctcccttatgggacagttccaaaaacaaataaggtccgctgtctggatcggattgatcgacccgcagcgaaccaacgacatcccttcggaatacctgtcgtccgaagacaatcccaataatgataccaataatcatgcaaagaatgagctccatattcaatcctgcctttccaaaacatttttccaaattttctacccgggattttttcacatatcaacatagcatgtctttcggataccttggtactgtgttttatcctaggataaaaaagaaagagccattgctggctcagtctttaaagatgttatttctgcgttccctcgccctcatacacaattttctttctcatgtcggaccaggcaatataccgctcttttcgacatacaggacaatggaatttacatacctttcctccgatgtccaccacctctttgctgtctgcctccaatcggctctgacaattcggacagttgaagcgatagactttcttgactgctatgtctacaatcttcatttcaatccctcgctttattcagtaaccagaagaaccgtctgtacaagttgtagtaaacatccttacagcatgggatatttgatctagctttcagaatgtcataagaccaaccttcggttacgccttttaaaatataattggatagttccgcatctgtcgcaatcgccgtttgctcgatcgttttcatacgatccaaatagtaagatcgagcttctgcacatcgagctgtcggatcgccagtcgttctgtttcttgagaatatctccatatcagcaggccggcggctaagcccatccagagcggcatatgctttcttccatatcggatactgtaggcagaaatgcttcaattcatagtaccggtgacgctcaatccaatatgggtttttctcggataattctggacgaatcgttgttgccatattaacgtttctctcctttccataaatatccggtttcttcccagagccgctttggagaaatataaaagttgatgcgtccgtacttcgaattcatctcttcgatattggtaatcaactttccgtttctagtcgcttttccaatgggaagccatccggatataataccggctcgaacccaggaagcatctttcccgtatactctggcgacgaccgctaccggaacggagcccggtgcaaatatcatttcttccattggctgttacctcctttcaacggctattctaggataggaaccgcaatttgttaaaacaacctcagtggcaaaacgacaaaaagaaagagcccttgttaggactccattctcttgaaatataatttttgtaattttgctctcattcttgtcaattcgatttgaatcgcttctgcttgaccaaaattcttacatcgtaaaagcatatcctcaaatattcgaattttagtcggtaagtgcttttcctcttttgacattatgaatctcctttcgttttatctttcacaaaaggagttgtaattcctgcgaattcctccatcgaatcatcgtcatttcacaagggtaatcctcatatccatatgtttcgcaagtaataaatccttccagaacgccacgaattacctcggcttcgtactgtttgtatggaaaaatataatccggcaattccctatgtatctgtccgcaaacagggcaacgaaaccgttccacctttacccatgatgtttttcttccttttgttcgcacaattctcgacacgttatcataccgtttcacccttgccccgcagttccgacaggttaatttttcatcactaaccatatacccatccttttaaaaagtttagtgtaggagttgacaattcctacaccatcatatatgattactgatgataaatcaaccttgccacgcggaaaatctcattttacaaaggtattgaggaggtatgaagcatgttgataaaatgccctgaatgtgagttgcaggtaagcgacaaggcgacattctgcccccattgtggttatcccatgcagccagatgtcagacctaggaagcctcgaagtaaaaataacaaacggagacggctccctaatgggtttggacagatcagtgaaattaagaaccggaatctaagaaacccttttcgggccatggttacagttggaaaaacgccagagggaaagccgatctgcaagccactaaagccggaatcttattttccaacctataacgatgcgtatgcagccttggcagagtacaataagaatccatatgatttggaacccgctatcacagcaaaagaactgtatgaaaagtggaccgaagaatatttcaagactttgaagaatgattccagtgcaagagccgtagactctgcatgggcgtattgttcatctgtctatgatatgcgagttatggatatccgagctcgccatgtgaaaggctgtatggatgagggcgtcgccatcgtaaagggaaaagagcagaaaccgagcgcttccatgaagaacaaaatcaagtctctattcaacctgatgctggattatgctttggaatatgaaattgtcaaacagaattacgctcgaacttttaccttgactgatgaaaccatcaaagaaattcagaccgtcaagaaggaacacattccattctccgacgatgaaatgaagttactttgggaacatgttgatgataaatattgcgttgatgttcttctgattcaatgttattctggttggagaccacaggaattgggattgattgaactgagcaatgttgatttatcgaaatggatctttactggtggcatgaaaacagaagccggcgaagaccgaaccgtacctatccatcccagaattcaatcccttgtggaacgaaaatatagagaagccgaaaagctaggaagcaaatatctttttaactatgtcgatccagatagccgacagaaaaatatcaagcttacctataaccgctatcaaagagtatttagccgcattcgtgacgagcttaatctaaaccctgaacaccgtccgcacgatggcagaaaacatttcgtcacgatggcaaaaaaatatgacgtggatgagtacgccatcaaatatatggtgggacataagatcacggatattacggaaaaggtctatacggctagagaatttgattggttgcgagaagagactgaaaaaataaaatagcttgtagaccggacgaaccccattaggattcgaagcgtctgagtggtgcgtattaccattggttcctacaccagcgaaagcagccgaagaaacgacatctctgagccagaaaagggttcggatgcttaacaaagtgtaggaatatagatataggaatggtgcaggaataatgtacaagttacctacatttccctgcttttacccactcctaaccacttctaaaagtattgattttactggatttttgacaaatctcttgtctagtaagtttctataataactatcgataaaaaagcaatatacaagcttgagtttagacgacttttagttaagcaggcgagggcgcctccggtacggacagcggacggggcggccagcggattgagtgtatatgagtctttcgtcccggtggaagcttgtcgcggtttggggctgcgggcgaagataaagtctgcggagcacacttcgcccgtccgccggcctgcggccgctcagagcttccatatgaataagatatattaatactcaactttccacatgtatcttctctcatccatggagtggccccttacctccgccatctgtgatacgtaataacgctcaatcgggatcatcacgacaggattaaagaattctgcaactgccgggtctatctttcctgcatttaattccttaaaatcgattacaatatagttttttgcatatttttcaaggaactttaagcacctttcatccaggaaacgcgttcttccctcgctcatcagaagtaccatgggaagttccttatccgtagtctcaaacggtccgtggaagtattcgcctgtatgcaggcagacagcatgtttccactgcatttccataaagtgacagcagcacatggagtaagcgaccccatagttcggaccggatgccagaacatagaataccggctcgtctttgtatttctgtgcccactccgttgccgcgtagagaacattctttttacctgcctctactatctcatcaatatactgataggcctccatagccttgtcgtaattctcataattctcaatctgtttcagcagttcaaagccgatccggagggagtttgcctggtttgaatcactgtatacctgatcatcgccatttgaataggtaacaacatactggccggctttcgccattccggtctccatagagcctgtcattgcgattgtaaccgccccggctgcattggctgtctttacggcttccaccgtctcaggcgtcgccttaagggaacagataacggctacacagcgtgaatccagttctttcggtgtggcgtgaacaaattcattgctcgtataggtagtggcgccaaatgtcttcgcctcgctctgaagaaggtaaaggcccgggtaaattgccgccttggagccaccgcaggccacaaaataaacgtgtttgaggccgcctgcctgatccatctttgttttaatttccgctacgatttcttttactgtttttgtcattttcattcctcctgaaatcttttttgttttcatctattatctgctaatatgtaacaccgtggccaaaggcgcctctgacaagacaggttttggaggcaaactccgccccccgtaccattgccttcttaagctcttcccggtaaaatccgctatcctttttcatgcgttccggcgctctcttaaggctctccgtaaaagagagcagaaaggccgtggcaaaggagtcgccggcccccagcgtatcaacagcttctaccagcttcggcggctgctcatagaaatccttcccgtcaaataacattgccccatagctgcccctggtggctataatcatccggcagccctgctcatgcatattccggcagataccgcgtgcctcttctgatgtaaccgaaccacaggataagaatacgtaggatgcatatggggcaaccccggcaaccctctcctcatcggtccattgcccggaaaagtcataggacagcggtacgcccgtggctgctgcttttgcaagctggctgtcaaaatggctgttgttgctcgtatggatgatagaaaacccttttatgtattccagatcctctccggtcaaatcaagcggtttttcttttgccactcctcctttattactgcccaggaaaacgcggtccccatttgtcaaggttaccctggcacagccgttctccccttcatactgcctgcaatggccgtgttcaactcccagttcatccagtgtcctgatcacatgagccgctgccgcgtcatttccaaagacacccatgtaggaggaatcggccccgagcattttggcataagctacaaaatttagcgcctggcctcccggaaacatcgtttttagatgttcatacttgtcacatacgttgtccccaataccgattactctcattatcctctctcctctttccgcccaattgattatatatcattatataatgttatgacataatattagtccacaaccgggagtttgtcaatagtattttttcagttttatttcttccggcattacaaacagtaacaattcgggtgatttagttaagcaggtgaggacgccgccggtacggccagcggacggggtggtgggtggtgtatatgagtctttcgtcccggcgaaaacctgaaccggggaagtaggcggaatcaattgcggaggggacatgggagtccgccggtgcttagcgaggtccctcacgagcctagcatcccgatgcgcactccaaagagtgcaaacggtccccgcagcaattcattccggccggattccccctccacgacaacctgcccacggggacggaagactaagcccgccccctcaccacaccggacatggtccgttccggacgcgtcctcctaacctccgccttcaattacaaaacggcgcccggtaaataattaccggacgccgcagactatagacaaagcggctctgggatgcaaatcccagagccgtttatcaaaacattactttctgaactggtcaataatgacagcaaccaggatgatagcgcccattgccaccgtctgccagtatgaagaaacgcccagtaagctgagggcattgttgataataccgattacaaacagaccgaccacggtctgagggattccgccgcgtccgccggacatgctggttccgcccatggctacggccgcaatggcatttagctcatagcctgttgccgctgtcgcctgtccgttttgaagcttggaggccagcacaagtcctgctaaggctgccagaataccggaaatcacgtaaacagaaaaccgagtcatggttacattgataccggtcagcttcgcaacctccttattgcttcccactgcataaatataacggccgaagcatgttttagagagcaccagataggagagcccaattacaataaccattaatacaattgatacgggaataactccgatgctgcgaagtcccacccatccgaagctgtccggcaggccaaacactggtttggcatcggtaaatacgtaagcaagtcccctggctgcattcatcatggccagtgtggcaataaaaggcggaacgttcaacttggcaatacaaaaaccgttgatagaaccgcagattgttccgaccacaactgctgttaccagtatcacagcaatacatgccgcaataccggcatccggcatctgcttaatcaggctggctccggccacacctgcgattgctgccacagagcctacggaaaggtcaattccgtctgagaggatgacaaatgtcataccgcaggcaatcagggcattaattgacacctgaatcaaaatattcatcagattgccgcccgtggcgaaccgaggcaccccgatcatacaggcagcaaacagaattactgcaaaaaataacattgtattattaacagcaaacgctttcactttgctttgtgttacttgactgctcatttacttttcctcctgattcgttcccttgctggcaaactgcataacccgttcttccgtagcttcatcctgatcgaggaatccggttaccactccttcccgcataaccataatgcggtttgagcatccaataatttcaggaagctccgaggatacaagaatgatacttcccccgttttcaacaaactccttcatcaaagcgtaaatctccgattttgcattgacatcaattcccctggtcggctcatccatgattagaatccgtgacttggccagcagccatttggcaatgaccaccttctgctggtttcctcccgaaagattcttaagcagcgccagctccgacggtgtcttaatcctcagcttttctatatatgacactgactcctgcttttcccagccaaagttgataaacccatggttggagttggcaaaaagcgatgccagtgatgtgttttcctttacatttttctccagtaaaaggccctgcccccttctgtcttcagggattaggccaagtccttttttaattgtagctttgggcgttttcgccttgtatggctttccatccatcaggcactccccgctgtcataaggatccgctccaaaggcagcccgcatgacctctgtgcgccctgcgccaatcagaccggccactcccaggatttctcccttatagagcttaaatgacacattgttaaacattccggctctcgttaagttccggacttcaaatacgatttcctttgtttttggcggctccggtttaaaataatagttggaaatctcgcgtcccaccatcattgccaccattttatcctctgtcacctcactgaccggtacggtatccaccagcgttccgtcgcgaagaaccgtcagcgtgtctcccatctccaaaatttcttttaaccggtgggaaatataaatgatagctacattctcgcttttcagctttctcattaccttgaaaagcgcctgtacctcatgatcggagagggaactggtcggctcgtccataataaccatcctgctgttctgggataccgcccggacgatttccaccatctgctttgccccgttatttaagtccctgatatatgcctttggatcaatatcaatttcaatagcttccatcagttcctttgtctcacggatcatacgggctgcatcgacaaacccgccgctctttaactcccgtcccaaaaagacattctcataaaccctcagatcatcaatcacgcttaattcctgatggatgacgctgattccgaacttccgggcctgcctgatattggtcagatgctcgtttttcccctctattaatacctcgccctcatccggctggtaaatgcctgaaatcattttaatgatcgttgattttcctgctccgttttctccaagcaggacatgaaccttcccgcggtaaaaagggatggaaatatcctccagaaccttcacacccggaaatgatttgctgatatgttttaattcaacaaacggtgtttcctggactccctgcatcattcgttcccctttcttatcagagggcgcctccatggctgtcaccagtcaaagtcggcgccccccggcaatcagacaatgctttctgtctgttttaattattgtgcattctcagcatcgatcatataaggggagatgaggatttctgcctccggtgttgctccttccagatatgattttacagtgctcagtgtggtctttccaattgctaccggatcctgagcaacatcagccacccagctgccgccttttttgatttcagcaatgccttccggatttccgtcgtaaccaatgatctttgtatctgcgcctgctgctgtgatggaagataatgctccgatggctgccggatcgcctacacagaaaacaacatcaagctgatcatgctttaacagcatattctgcattacgtcggccgctttctgctggtcgccggaataattctgaatatccactacctggatatccggtgcattggcctccagataaccggtaaatcctgtttcacgatccacacagctctcaatctcagaataagtaatgactgctgctgttccttttttctctgtcagaatcttttcaaccaggtactgtgctgccagctcgccgccctttttattatcggttgcaatatggcttactgcctgaccgtcagatttaatatccatggtaaatacaggaatgttctgagcctctgccagctcaatcatggatttggaaccggctgaattggttggcgcaattacaatggcatcaacacccttggtaataaaatcctgaacctggcttaactgtttgttggcatctccggcagcatcctgcacatccagagtccatccgtactcagccgcctgctcttccatggctgcctggatattgttaaaaaatacatgtgtgctgtttaacaggctgacaccaactgtgatatcttctgccgtctttgcttcagccccgcctgtagcttctgctgcctctgcttctgctgctttggttgtttctgctgccttcgttgtttctgctgtcttacttccgccggagcaggctgtcagcgataccgccatcatagctgccatagcaagtgccatcatttttctcattgttttttttcctccttgattgcattaatatagttattatgtgaacccggagcttttcccccggattacgcccactgctcttatccttctcttccctggcagtttaacacctcaagcttgtgaagcaccagcttctttacagcctctctgccggctgccccatatttctttggatcataggtatccggattctcctttaagtacgcctttacgcctttggagaaagcgtctctcagctctgttgcaaaattcaccttgcaaattccaagtcctgttgccctctttacgtcttcgtccggaataccggatgccccgtgaagcacgatgggaattgaaactctttttcttgtctcttccaatatatcaaaccgcagctttggatcacccttataaaatccatgggcattaccgatccccaccgccaatgaatccacacctgtccgctctgcaaattctccggcctgttcaggatctgtatatgccttttcgctgtcctttacctcgtggttatcttccttgccgcccacggttcccaactctccctctaccgggattcccatagcatgggccatctcggccactcttcgggaaagtgttacattggcttcaaattcctctttagagccatcgatcatgacagaggtgtatccggcttttaatgcccttgctgccatttcaaagctgttgccgtgatccaggtgaagtgcaaccgggacagaagccttttgggccgctgcggcgcacatcccatagaacatctcgggatctgcataatttaaagtccctggcgtggtctggatgataacaggcgccttcatctcctcagccgcctcaatcacagcctgaaccatctccatattttctgcattaaaggcgcccactgcataaccttcccgctgcgccttcagaagcatttctttcgttgtcatcaatgccatttttatttcctcctgtcaaacctctacaatacggactctggaaagcatggcctccatatcctctttttcacaaagctgtgtccccggatgcaaaagggaacctgtggcgcaggccactgcatggcgcaaaagatctgtctcattcattcccttttcaattgcataacaaaagcctgccaccatagaatctccggctccctgtattcctttaatatctactgtgagcggttctgccacatagacatgctctttgcttacaagcactgcgccttggctgcctcttgagacacagacataggttactccttcctctatcaccttcctggccgtccggataatgtcatccagattctgtaccgccaccccgtaggtggcgcccagctcgtcctgattaggtttgatcaggaacggctttgccttaatcccctttttaagaagctctccggacgcatccagaatagttttcagtcccttttttcctgcctcttctatgattctttcatagatatcttctggaacgcccggaggaacagaaccatccaccacaatcactgacgccagatccatctgggtatataaaagcttcaaaaagctgtccacattctccgctgttactgccgagccccgctcattaaactcgctcataacagaggtggcgcaatcaaagattttaacattgactcttaagcttccctccactggctccagcttataacggcagccaagccggtctaaaaatccggtcagcttctttgtgtcctcctgataatcaaagccggtagccagattttcaattcccaggtgctgtaaaacaagatttacgttgattcccttgccggaaatatcgtttctcgtcatcagtaccttattagtcccgccatattgaaatttttcaacttcaatggttctgtccacacaagggtttaaagttacagttataaccattctttcctcctgcagcgttcggaaaacgccgtcgccggttgttccggcttttatatattttatttattctcacaaatccactcatgcatagagcggaatatgatccagacggaggttgcccccgcatcctgtaagcctatggctttttctccaaaatatctggctctgccgaaccgggcctttactgtctttgtatattcaacaccgtccctggctccctgctccgccttcctaagtccctctttcatcgtatccccggcttctgccgctgcctttagtccatttaccgccggctctaatgcatccaccatggtcttgtctccgaccctggcgcggcctctctgtttcagcgcctctaacgcttgggaaaagatctcataaaaatcagttattccgactgcttcatgatgctcccgcctggtcagtccgctgagaaataccgttccgaacagaactcccgacgcaccgcccatggtatccagcagcgtagttcccacgaactgcagcacatcctctgcaaaaaccggttcaaacccgggaagcgcttttgccacctcgcagaatccgcgcttcatgcctgttccatgatccccatctccgatttttaaatcgatctccgttaaatacggctcattctctacaattttttctgctacatagagcatcatggattttaactcttctctatttaaggtatggctgtccgtcttctgtccttccacattttggttctcccggcgctgcactgccggcttcccttcagcctctgccgcatccggcctctttgtactgccataaaagctctttgtgcctgtccggccagcttctgttttatgtactacctttcccttcttaaaaagcggagaatcagccggctggtcataataccttctgtatgcttcatccattcttaaaaaggtcagtgaaaaaccgcccgccccctgggtcggaaagagagaatccacataggaatcatagacctttattcccttttcctctaatagttcaaggcactttctcattaatgtgtaggattccaggactgtagtggccttatacggatttaaaaatacggctatctcctctcctggttccagattcatatcttcccaaagcatctgaaccatccgctccattacctcatccgctgtggagagagcagttcgttctattcctttctccccgttaaagcccataccatactccatttcgccgtctggaagctcgtaagccggctgtcctgtctccagaatataggccggtgaggttgtgacgctgaccgtataaatattcttgtttgccatactggcgatttcatacacctcttcaaggctaagacctgcctctgaagcggcggcggcgatcttcactatcagggagacgcctgcgattcccctgcgctcttcccgctgtgttttttctgccgatgtgatgtcatctgatacgtaaatctgtctcgtatggattccctccatctctgccaaacctgcaacaagctcaaaattaagcacatctccggcatggtttgtggcaatacataaaacgcctttttcattcggaacataacggattgcatttaaaattgattttgccgtgggagcagcaaaaacatttcccagggagcatgcatctgccagtccttctcccacgtatccgatgggccacggctcgtttcctcctcctgctccgatgacgattgaaaccttatccttctcatttttattgagaagcacatgatatccgtccagcttgcaaaaacgctccggatagcttgcaatatagcctgccagcatctcgtctactacctgttccgggttattaagcaatcggttcattttcatgctccctcctatttattaacatgctccgtactgatctcttctgaaaatgccctgtaatgggataaattttccttctcatgctttgtggccaccatcatataaagacaatccaccaaaacaagctgtgccacattttcgctggatggctcgtaaagcttccccatcttgtccgaggcgtaatcataggcgctgaacaacacataatcagaatattgagccagcggcgaatcctttacactggtaattcccaccacggtaactcctctgcgtttggcgcgctttacgccctccaccacagacttgctttgcccaaaattgctgactgcgattaaaagatccccttcttttaaaatagaagtaatattcacaatctcatgggaatcacaaaaatccacaatataatagccaatacggtacaatctcgacaccagagcctctgttgtgatcttggagcggcctactccgatggccacgatccggtttgctctgtcaattaaatttgcaaccggctccaaaatgtcaaaatccatcatattccaggtgtcttccaattcccggatgctttttgaaaaaattgttttgctgacttcgtagggtgattttcctatcgcttcaccgttatataccagcctgtccttttcttccggtttttcattcacattcttttcttccgtcactgccattttcaaacggaattcattaaaattcttatatcccagaagttttacgaaacggctgaccgatgcagtgctgactccgcttttttctgcaaaatcgctggctttcagatagataatatcactctctgacgatattacataatcggcaattctgcgcatagcttcattcatttggggatagcggcttttaatctcaattaatactggtgatgacatatacatttcctcttcttttgtaatataaatggattcgatatttaaccgcttcattataccatgtttccggcggaatttaacacacagcttttctgcgatgaacgcagaacctgttcatttccgccatactttcagtcctcattttcgttctgaatttttgttttgtatttttgtttcatatttttttatttcaaaaaattaagtttcataaaatttagttttagtatagatcggaacaatccttttgtcaatattaaattatattttctagtttttgctaagtttattgtatacatttactcatctcaagctattttctcttatcctccctctctgttttccctacttttttctatttgtttaaaactatttcagcactttaacagacagaaatcaaataataatatgcatttacctatcattggagatttagttaagcaggtgaggacgccgccggtacggccagcggacggggtggtggggtgtgtatatgagtctttcgtcctgggggtattatcgtggtgtggggctgcgggcgaagataaagtctgcggagcacactcccgctctgtgaaatgcatcgcgctgctaagctcgacaggacctcgctaatcagcgatggatttcaacggcatccgctgactttatcttcccctccgccccaaggccaggttttcgctaggacgaaagactccgccggggggatcgccccgtccgctggcctgcggccgctgactgtctcacgcgttaagtgcggagggcggaccttgtcgcggccactaagagcttccgtgtgcgggaagcacgatatgttcaatgcgcctttatgaaagaatcgcggaaggtttgatatcagcctgcctgaaacacgtagtggccgcgacaaggccctccccatttaaggttggagacaatcagcggccggaacggaccatgtccggtgtgcgaaaacctccgcctgagtcttcggtccccggcgaaaatctgccccggggaagtaggcggaatcaattctggaggggacatggaagcccatccgtgcttaatgaggttttttcgaatttagcacggctatgcgcttcgaagtgcaaacggtccccgtaagaattcattccggccggattccccctcacaacaacctccaatcggggacggaagactcagacagccctcctcaccacaccggacatggtccgttccggacgcgtcctcccaacctccgttaaatctctgacaacagatcaccgccctcaattacaaaacggcgcccggtaaataattaccggacgccgcccatatcactctttgtttcttatattcctgttgactcacatacatagaaggagcatctgtccccgttgaatatctgagtgcccacatatattggttctttttcctgggtataggcaacactcttgatataaagcagggaggtacccttgttaagctgtaacagctccgcttcccgggttgtggccttgcacagctctatccatttttccgaaacagcgaccataacacctgctttatccttcataaactcaaacagggagttgctgtcaaaggtttctccgagaagaaatgcatacttcaacggaaaatagttgttctctatcgccaccggttcattatctgcataacgcaccctggaaatatagacaacctggctgcccttttcaagccccagaagatttcttgtcttttcatccgccactatcagcttattctcaagcatacgtccgccggacttcatccccatatgctcgcacatctcggtaaagctctgaagtttcttgatgtcctttgtaaactttggctttgagacgaaggttcccttaccctgtttcttctccaccagtcccttgtcgaccagtgcgctgacagcattcctcaccgtgataatgctgacgccgaatgttttcgccatctcgctctcagactggagcctttctccgggctgatacacgcctttcataatttttgcttcaatctcagtcatcaattgaacatatagtggcgttaccgcctttccatccaacatctgtatcattccttttatttttattatgatctgcatagatcattatataatgctcttatgaaatattatataacatcattaggtaaaaggcaaaacaattttttcttctctaaccatcatcatataagacccttttacaagtcaacaaagtagcgttaacacacgtaattaccaattctttgacttgccgaatattggaaatcccccggacgccttaggttaaagagttccgaggggacagtcaataaaaatgaatattttcttataatcttagtattccaccttccacatataacgcctgtcatccatggaatggcccctcacctcggccatctgagccacatagtagcgttccacgggaatcatgacgacaggattaaagaactccgctatctcgggggcgatccttcctgcgttcaattccttaaaatcaataataatatatttttcggtatactttttcagaaaggtgaggcatctttcatcaaggaccctggtgcgcccctcactcatcagcagaaccatcggaaggtctttgtccgttgtctcaaacgggccgtggaaatattctcccgtgtgcaggcagacgccatgcttccactgcatttccatgaagtggcagcagcacatggagtatgccacgccgtagttcggcccggatgcaaggacatagaataccggctcgtctttatatttttccgcccactctctggcagccggcagacacttttcttttccctccgcaacgatttcatcgatgtaccggtatgcttccatcgccgtctcatacttctcatagccttcaaactggttcagaagttcaaagccgattctgagcgcattggcctggttggaatcgctgtacacctgatcgtcaccgttggaataagtcaccacatactgtcccacttgagccatcccagtctctgtggaaccggtcatcgcaatagttacggcgccggccgcattggcggtcttaacagcctccaccgtctcaggagttgccttcagggaacagattaccgcgatgcagcggctgtccagctctttgggggccgcgtggacaaattcattgcttgtataggtggttgccccaaaacttttggcctcgctctggagcaggtacagtccggggaaaatcgccgccttggatccgccgcaggccacaaaatagacatgtttcaatccccccgccgcatctattttacatttaatctcgctgataatttctttaacgctcatatcatgttcctcctgtcaggccagcctgaagctgctgccatccttctctatttttactccgtataattcttccgccttatcgatcgataccttatgttcaattacatcggacaggacggcttccggttttcggttcttcggatctccgtaacctccggctcccggtgtgtggacggtaacaatgtcccccttgtggagcggcacatcggtacacttactcatcagcttttccaccgtgccgtcggtgcgagtgatgaaatattcacctccggctccctccatgccgccgtaaaggccccatggcttgtacacctgcctgtctcccagcccggtataattgatattatcgtacatcgcttcaaaaatccgctcgattcccagtccgcccctgtattctccggcccctccgctgttttcaatcaatccgtatttatggacaatcagaagcggaaattccatctcaagggcctcaatcggcagattggaggtgttggtcatatgaacctggaccccgctcagcccgtcattccccctctgggctccggatccgcctgcaatcgtctccagatacacatagaaatggtccggatccgcgggatcggttccgctgaaaattgcggaggtacaggatgagttgcagccggccagggcgcgttccggaacagccgggccgagcgctccgaaaataacgtcggccaccctcatacaggtgtcgatacgcgcgcccacgggcgccggattcgtcgcgttgatgatcgtccccggttccgcctcgacgctgaatgccctgtaaataccggcattggaaggaatggtgggatcgatcagcgcttttaaggagtaaaataccgttgcgagaagcccatttttcgtgacattgttcggtccgttgacctggggatcggttccggcaaaatcaagatgcatattatcgcctctgattgtaacctttacctggatcttgatcggcctcggatgcccgactcccgcgtcatccatataatccgtaaactcatactcgccgtccggcagctcacggatccctgcccgcagtcttctctccgcataattctgaagctcatgcatactgtccaccagcagatcgccatagcggtcaaagctttcggtcagacgttttgcaccgacgcggttcgaggcaatctgcgcctgaagatcgccgtagcgctctcccggaatgcggctgttggccatcaggaaactgatgatatcctcatttacctcatccttttcgcatatcctgacgagaggaatcttaagtccttcctggaaaatgctgaccgcatctccggatgtggaaccggccactttaccgcccacgtcgctgtgatgggccaggttcgcaacccagccaatcagcttgtcaccgacaaagaccggctgtgtcacggtgatgtcgggaagatgggtgccgccgccgttatatgggtcgtttcccataaacatatcccccggcctgatatcctgggccgggtgcttcttgtacacttctttgattatgccgagaagggagccgaggtgcatcgcaacgtgttccgcctgggcaaccatatttccctcagggtcaaatactgctgtggaaatgtccctgcgctccttgatattggtggaataggcgctcttaatcaacgccacgcccatctcttccgcaatcgacagaagaaggttccctacaatttccacggttactgcatcaacttgggttttcattattttgcacctccctcgtaagtcacaataatgttctggtatccgtctgtgtacgccttccagtccggcggaataacagaagtagaatccatctgctcgatgatggctggtcccataatcgtgcatcccggtttgaaatcattccgattataaatgtttgtcgtgatatagtccttttccctgtcaaacagtacttcgcgtgtggtgaaaggctttggaggctccgcattcggatctgccggcatttccgccaaatccggcttgatgatgtcgccgatggcgctgacgcggtagtttaccatctgcagtttcatgctgcggttgaagtaaccataggagcggttgtgttcctgatggaatcgttcaatcatttcttccatgacttctttcccgaactgtcccttcacttcaatcccgatctcataattctgcctctcatagcggcactctatcagataagtgaagcttctgtctttttcagctacgccctctttatccagaagttcattcccctccgcagtcagcgtgtcaaatattttctgcaccttcggcaggttctcctcctcggccagcatgacattggaacggctgatatcgaatttcgtatcggccatcagaaggcccagggaacagagcgttcccggggacggcggcaggagcacggaggtaattcccatatccctggccacctcacacgcgtgcagcggtccggcgcctccgaacgccatcagggtaaattcacgggcatcgtatcctctctccacggatacgacgcggattgccctcgtcatattggaatttacgacggaaatgattccggcggcggcctgttttaaatccagggaggatttatcacagatattttctttaatcgccttctcagccagcccgagatccacgtccatccggccgcccagtattttcgtctggttcagcttgccgaggacaatattggcatcggtcacgcaggcctcggttccgcccctcatgtagcaggccggtcccggcgtggcgcctgcgctgtcggggcctaccttcagcgcgcctcctgcatcgatcctggcaatggaaccgccgcctgcgcctaccgttacgatatcaatcatcgggattctggccggatatccttctacgagtctctcattggagagcgacgccttcccgttttcaatcaggctgacatcaatgctggtgccgcccatatcgaaggtgataaccttgtcaatgccgcactgctttccaatataaacagcgccgataacgcccgcgctggggccggatacggctgtcttaatcggacagtcaattgtctcggcgatggatatgacggagccgttggactgtgtgacgtagggcgctgccgtaatgccggaatccagaatggacttttcaaaattatgtacgtatttttccatgaccggtccaagataggcattgagtacggttgtactcattctcgaatattcgcggaattcgggaaccagttcatgggaggtggatacataagcctccggatattcttcattgataatctcacggatccgcatctcatgctttggattgataaaggaaaacagcgtgcatacggcgatggtctgcgcgccctgttccttcaggtaacgcactgcctcacggacactgtcttcattcagggcggttttaaccgtgccgtcataaagaatccgttcctccacctcgcgcttcatgccgtccggtatcaggctctccggcttctgttttgacaaatcgtagagggaggggcgtttctgccagccgatttccatcagatcccgaaacccttttgtagtgatcaggcccaggcgcgctcccttcttctctatcagcgcattcgttgcaacggtcgttccatgggccagatagctgacctgctccggtttgatgcagtcttccgtaagcacgtggagaatcccgctgacaatcgctcttgaggggtcatccggtgtggaactgtgcttaaaatgttttaaattccctgtctccgtattaaatattgagaagtctgtaaacgtaccgcctacgtctacgccaatcatatagctcatattgtcacctcattttatttgtccttcagttcgttcttaatttaaaaagctctgccatgtccaaatgctccctgtaccagacacgtggccgctgcaaaagaagctcctttttccatcgcttcttttagctgctgccggtacagctttctgtcgctgtccatccggtcccggtattcctttctgctttgagtcaaagaaagcagaaaggccgtggcaaaggagtctcccgctcccagtgtgtcaattgcttccaccaaatgaggaggctggctgtaaaaatcatgcccgtcgtaaactagagcgcctttgcttcctctggtcgcgacaataaaccggcacccccttgcatgcattctgtgacagatttccctgccctcctcctctgtgacggagccgcaggacagaaagacataggatgcatagggggcaacccggcagacgcgtccgtcgtcgatccactgcccggaaaaatcataggaaatgggaatcccggctctatggattttttccagctggctgtccatgtagctgttgttgctggtatggaccagagagaaggtgctgatatatgccaggtcttcctccgtcagttcaaagggatgctctttggaaactccccctttgttgctccccaggaatatccggtccccgtccttaagagtcaccctggcgcagccgttttctccctcatactgcctgcatctgccgtgttcaacccccagctcgtccaatgtctttattacatgaaccgccacctcatcggttccgaatacccccatataggaggcgtctgcccccagcaatttcgcatacaccgagaaattcagagcctgccccccgggaaacatggtttttaaatgttcatatttatcgcatacgttatcgccaattccaattactcttaccatgaccgcctccgcctttttcatgcatgcactgaaatttattagttactgttcacacggttgtataccgcgaggtgttttcgtgcgttttctgcacgaaaatcccgagttacacggcgcgaaactgcgttttttgcagtttctgtgcatcgcgaagcgtgttattgtttacatcatgctgtattttagcatggtgtgaacagtaacctttattactcttctacataggtatcctgtaaggtaaggccggaaagataggtcaggataccgtccagattctgaaatccgtgaacgttcttagccgttgcaaatacctgctccctgaagttgatgaacacgaacggtgaaagctccagcgccctctccctgaactgatcatatatttcttccctctctttttcgtccagtgtggttctgcccttctgaagcagttcgtcgattttgtcgtctgcaaagcccggacagctgttcaagcggacatcgccgctctcatagtaattggtggcccagtccatgtccacgatgtttcctgtcgtgccggaaaccatcatatcgtagtcgcctacattggagcgctcgatacgtgtcgcccagtccggaagctcaagctccaccttgattccgatttcagcgagactggactgtacgcataccgccgtctgctcatgcatggcataagtggaggaggacagcagcttgcaggagaatccgtcgggataaccggcttctgccagaagatcttttgccttttcagggtcataggaaaaataattgtcatattttccgtcgtatccgttctgtccgacgatggtcgggaacccaaaaatcggttctccccgtcccataaatgctgcattgattacatcatccctcttgattgcgtaggagatggcctgtcttaccttcggatccgccagcggacttccctcggtacagttaatctgaaggcacatgaaaggagctacggatacatctacgttggcgtctcccgcgccctcaaatgcgataacctccttcgacggaacgtagtcaataatatcaacctctcccgtccgcagcgcattggccctggtcgtctcgtccgtatagaaatagaaatcgatattaggcgtctgtaccggagtcccgtaccagccgtcatatttggtgacgctgatggaaagtccgttttcccatcctccgaagctataaggaccgcatcccatggcaaccgtacttaaatcgttattattcgcctcacagaaagccttggacactacggccgcctccggcaggcagaggtattccaggaacggcgcacacggctgttttaaaacaatttccaccgttttttcatccggtgcgttcacatgatccacaacagagcggaaatcgcttccgaaggtggctgctaccgattcatccatcacacgctcaatcgaaaatttcacatcctctgcggttaccggggaaccgtcgtggaaggtggcatccttcaataaaaaggtgtaggtcagcccgtcgtcggataccgtgtaagaatccgccacgtccgtttcaatgcttgaatcagcggtataggtcatcagtcccctgtaaatctgctgcttaatcagacgcgtggcctgtcccgattgcagatgaggatccagtgtggccggttcggcgctgatccccacatttaacgtatcctttttgctgccgccctcttctccggccgtaccctctgttcccgtggcaccccctgcctctgctgatgcgggctgcgtgtcgctgcttcctgtcttggagctgcaggccgtcagtacagcagatgccgccagtgccgccgccagtgtcagagcaacttttttcaaacttctttttttcatgaatcttcctcctcgtataataagtttgtaagcaagaaaaaccgcttacagacttattcttttttgggtataaatggtaaggatatctaagaggtactcccctcatcccgattcccatctatacagttgatagttacatttcaatataggtagatcctgtggtatgatatcaggtagagtctgatgtccgaaggcactgcttctcctcctttcagccggcttcgtccgagactgctttgaaagcattcagcctggcacatacggcacattccgctgacacagaattttcatccccagccgttagccccagcaaaaaaggctgactgggtgcatgctcattgcgcgagggttcggtcaccgtatgcggcacaggataaaccttttgcttcaggcttcacaaatccccatcggaatggaggtgatatcatgttaaagctcaactatatgtccaccttgtttgtaggtattgatgtaagctcaaagaccaatgccgtctatgccatggactttgaggaaaacaaatacatctcatcgtcgtttggcaataaccagccaggcgccgatcagcttgtaaatatgattgccgaatgcatgcagaagcataaaaacctggatacggttcttatcgtgctggaatctacttctgtatacagcgtgcatatttcaaacttcctgtcggccagcgaggttctcatgccctacaggccttacgtattctgtgtaaacccaaaggccgcttcgaattaccgaaaatcctatatcggaatggaaaagaccgatcccacggatgcatatctcatcgcggacttcggcagggtaggccgcacgaaaaaactggagccatggcgcggcgggcagttcatatccctgaaacgccttacaaggcaccgtatgcacctttctgagtgcatcaccagggagaagacttatatggtttcgaatctttatctgaagttcagtgaacttcagctccttgaaggtgatgacaagccttttggcagtctctatggtgccacgtcctcagctgtcctgacggaatttttgtctccgcaggagattatcgatatgccggaagaggagctgcttaccttccttgcggggaagagcaggaaccgcatctctgacctatcaaaaacttcggaactcctgcgcaaggcagccagggattcctaccggttagacaagtgcatgtatgaaccactgagcatatcactggcaagctcgtttaactgcatccacgcctatcagaaagaaatcaagctgatcgagcaggcgattgagaaatgcatcaacggaatgaaccctaacgccctgctcatccttcaatccatacctggaataggtccgatatgggcatccggaattctatcagaaataggcgatataaccgtgttccattcatccgatgcccttgccaaatatgccggcctttactggcctaagggtgattccggagatttcacttctgaggacaacaaaatgtcgaaagccggaaatccctatcttcgctgctatcttggcgaagcggcaaacagcgtcaggaagcacatccctgaatatgctgatttctatgccagaaaatatgctgaggtaaccaaacatcagcacaaaagagcactcgcgcttacatctcgtaaattagtacgactcgtttttggattgctggtcaaaaaccaactgtacaccggcgaaaagctggacaccgaatataatattgagtcgaactgacattcggttatacgtaaaatataccgaaggtctgttaaagttacccttttttctgaaaaacatatcaaaatcttcttcaaaaagttcttgacatatcaccagaatgcttttatttttaaaaactgttgttaagctttggatccagaatatctctgattgcgtcccccatcaggttaaccgccagaatcgtcaggcacaggcagacagccggccagaacaaatacatgacgttgacattcagatatccccttgccgagccaatcatctgcccccaggacggtgtgggcggctgaacgcccagccccaggaagctgagtcccgattccagcagaatcgcgtttgagattgtggtactcacctgaacaatcagaaccgatatgatgttcgggaaaatagccttccacataatagccgacggcgccgcgccgatcgataaatcgctctccacatattccatttttctgacctgcagtgtggaagaatatgcgacacgtgaaaaatggggaatgtaaaggagcccgattacaagcatcaggttaattacaccggcgccccacagtcccgcaataatcatcgccagaaggatgggcgggaagcagaggatgatatcaatgccccgcatgatgacggcgccgatccttccctccagatatcctgccgccacccccaggagagtgcctcccgcaaatgaaatggccgtccctcccagggctaccatcatggacggcctgattcccagaatcagacgggtcaggatacagcgcccgtactcgtccgttcccaaaggatattttgccgatgaatttttcagcatattgaccgtatcaagcgcatacggatcgttgggaaccaggaaattgccaaatatcataacaatgatcagagggaccagtatgataaagccaacaacaaacttcttattgctgaaacatttctttaacattttatccctcctatctcactcttgggtccagaattccatatattatgtcgaccatcatgttggtaaaaatgtaaacgaccgagatcagcagcacacatccctgtatcagcggatagtcacggtgattgatggcctttacgagaagggaggcaactcccggccagttaaataccgtctcgcagagtacggttcctccaatcaggtttccaagctgcaggccgataatcgtgataacgggaatcatcgcattgcggattacatgctttctgatgactttgccgcccgacagcccttttgcacgcagcggccggatggattccgccgccatcgcgtccagcattgaggagcgcgtcgtccgcatgatggatgctgccacaccaagggccagtgtgacggcaggaaggataatcttctgtatatgcatggccggatccttggaaaatgcggtgaacccgctggccggcagctttgcaatgggaagattgaatatattgagcgcaaaaaccaccacgagcagataccccagaacataaaccggcaccgaggttcccaccgatgccactgttgtcagcatcaaatcggaaagtttccctcttctaaccgcagcgataatccccaggggaatccccgccagacaggcaagcaccagggacacgaaggccagctccagcgtcctcgggaaacgtgatgcaatcgcctgtaccaccggaatcttctcggaataggatttccccagatccagctttacaattcctttcagataattgccatactgtaccagaatcggctgatccagtcccagctccgtgcggatcttttccaccgtgaccgggtcagggttgctgtcgacgcccagcatcgtaaggaccggatcgccgggcatcatatgtacaaatgcgaataccaaagttgtcacaatgaagagtaataccactgagattgcaagtctttttgctataaatttcaccatatcagctgccccctttcccggccaggaagcaggcggcaaaatgacccggccttatttccgcaagctccggcctctccgtccggcagcgatcctgtgcaaaaggacaccgtgtgcagaaccggcagccggccggagggtttaccggacttggtatatcgccgtttaatataatccgttctttcttctgcgtcgtctttgcttccggaatcgcagacagaagcgcttttgtataaggatgggacgcattttcatagatttccccgctgtcggccagctccacgatcacaccgagatacattaccgctattctgtccgccatgaatttcacaacggataaattatgtgaaataaacagatacgtcagttcaaaatctttctgaagatccttcagaaggttgagaacctgtgactggattgatacatccagagccgacaccggctcatcgcagattattaactccgggtttcctgccagcgccctggcaattccgattctctgcctctggcctcccgaaaactcgtgggggtagcggtttagccactcccggttcaagcctaccatatccatcagcctgagtacctcatcctccagcccgctttccggcaccgtatgatggattttaagaggcgccccgattatctccttcaccttttccctcgggttcagagagccatacggcttctggaaaatcatcctcatcttacggcggattttttccattttctttcccttcaggttcgtgatatcttctccattgaatattatggttcccccatcggcaggcaccaggtttaaaattgtcctggacagggtgcttttgccgcagccggattcccctaccaggccgaatgtctcaccttttcttatctcaaagcttacgtcatccaccgcatggaccgtacctttgctaccggaaaacatctttgccttgacagggaagtactttttaagatgatccactttcagaattacttcactcatcaatcaggcctcccttcgcaatttcctccgccctgtggcatctgacgaaatgtttctcatttagctttacaaacggcggctccttctctttgcatacgggaagaacaaagggacaccgcgtacagaaacgacagcccggaggaaaattcctgatgtcgggaaccgttccctgaatgctgtagagccgttccgcctttgtatcgagctgtgggatggatcggatcagcccgtgggtataaggatggcacggtgaattaaaaatcgtatcctttggtgcaatctccatcgattttcccgcatacataaccacgatatcgtcagccacatccgccacaactcccaaatcatgcgtaatcaggacaatccccatattatattctttctgaatcttcttgagcagctccataatctgggcctgcaccgtcacatccagggccgtcgtgggctcgtccgcaaacaacagcttcggattgcagctcagcgcaatggctatcatgaccctctggcacataccgcccgacagctcaaagggataggagcggtacacgcgttccggatggggaattcccacatcgccaagcagggataacgccctctttttggcatcggccttcggcattttctcatgagtcagaatcgcctcaataatctgatccccgaccgtataaatctgatccagggacatgacgggatcctggaaaatcatcgacatttcgttgcctcttaattcctgcatctccttttcactcagcttcagaagattttttcccttaaacgtaatctcaccttccgccacccttccctgattcggaagcagccgcagtacggagagagacgccatcgtctttccgctcccgctctcgcctacgattccgagggtttttccctgttcaacagtgaaactaagtccctccaccgcagcaaatgaggacttcttattctggaataccatcttaagattctctactttcagtaaaacttctcccatccgctcacactctcttctctttactctctgtctcttccgccagattcagcagccccgtttgcatatgcgcttaatgcgtataatatttagcatattattatgtatcattatataatatgtagatgcataaaaaatggctgtttcaccgcgccagctcattatataacattacaagatatgttattctctttagaaaaatattatcattttgtaaaatccttgtcaagatatttgaaaactttttattataatcttatcaggatgaaaacaccctccatcacaccctgtattcttagcaaatgcacagtattttgttagatttctgacaatatttcattcttatatccgtttctttatccctcagataaccgaatcagctccggctgtctctgtcaggccttgataattaaaggttttacccttattcgtcatcaatattatgcttatctgtcccgttaaaaaaagtacaattggaatagttttacagagacgccaaaaaagccaaagtcatcactcatgctgctgactttggctttctgccgtgttatcatgtattcatttatcggtcgtacccttatacggccgtcttttccgcttctgccagcgcttcgtcaatacagccaaagaaattttcttcccctgcctcatgacagaagccggccttcctcataaccctcatcggttgttcattgacatgtgaaagcatcagccggattcccttctccctgcagacactgtttagttttctcaggctgttcagcgcagtgatatccatagccggaacacttctcattctcaggatcatcaccttcttttcttcatgaaaaggcacttccagaatcttgtcggcggcagcgaaaaacattggcccggtaatttcaaataccgttgtatggctgggaaccggcttcaggttcctgttgtccttgccctcctcataatcgtccagataatcccattcctgcacatccgccacatcagccatccggctcaggaagagcagggaagccagaatcagccccactgcgatagccacaaccagatcaaagataacggttaacgaaaaggtcagtaccagtacggtcacatcacttttcggtgatgtcttcataatctctgcgaacgtgcgccatccgctcatgttataagccaccatgaacaggattgccgcaatggccggcattggaatcaaggccgcataaggcatcaaaagcagcagcgtcaaaagaaggacgacggcatggaccattccggctacaggggaggttcctccattcctgatattggccgcggttctggcaattgcccctgtcgccggaataccgccaaacagcgcagaacccacattgcccagcccctgcgcaaccagctccatattggaattatgcctgctgccgatcataccgtcggctaccacgcaggagagtaatgattcaatcgccgccagaattgcgatggtaaatgcatccggcaaaacggtttttaccagttcataggatacctccggcaggtgaaaagccgggagggaggaagaaatcgtatataaatcccctatcgtattgacattcagccctgccgcctttaccaacacggccgacacaagaacggcaatcagggacggcggtatcttcttaaagaatctgggccatatgataagaatcgcgagcgatatcagccccactgccagcgcctggacgttcagcgtcccgaaacaggcaattacctgctccagtttctccatcgtttccacaggcgccttttcaaaggccagccccataaaatctttaatctgcccaatcacgatagtcacggcaatcccggccgtaaagccggtggtaattgtaaaaggaataaacttaatcatgcttccaagatgcagaagtcccatggcaaccaggataattccggccagtacggtagcaataatcagcccgtccattccgttccgggccacaatacccgccacgattgaggcaaatgcggctgtcgggcctgcgatctgtactttgctgccgccgaaaaaggaaataatgaaaccggcgataatagccgtatagagcccctgttccggtgtcacaccggaggccagcgccagagcaatcgacagcggaagggcaatgatggcaacgataacacccgctgtcaaatcccccgccagctgttttccggaatactccttcatggatagaaacaattgtggtttcagttctttcatactaataaaactccccttaaaagtaattaaataataaatgttaaaaatttgtaaatatgttccatcccaatcttacactcaccttccgccataacacaagttcttttttaagtactttgttttttgtatacatctcaccgggaaactggttgccgattatcagcctgcatgctaaaatcataacgttacggttaccataagacggctacctatcaggaggaactttccgcatacagggccggtattaacgattaaccggggcaaaaaatcccgtacagcctgaataaaaggccgtacgggatttattacattgtctggactgcttcagccgtttcagccagttactgggctgccggcatctccacttcggtatatccttctgtgtcgggaagctctaccgtcacatcctgtcccgggttattcactttaccggtcaaatccaggaccatggaaatagactcgccttccattgccatatccacactcatcttcattgtcatgtctgtgtagaatccgtctttgtttacagtataggttccgctggcctctttgaaggtcatctccataccgtccattgtgcccattccgctcatgctgcccataacttccgataaataagcattcattttttccgggtcagcggtaaaagtaaggattgtgctgtccccctcttttgccatggtaatctctttcatctgctcggactgcaggtttgtactctcggtgctctgtttaacagattccatcaattcggtcaaatccatcggatatttaatcttctggcccattccgtccatgtaataatatccgtctttatagaaaatcctggcatccatgctctggcccatcagggaagtttttgtgtcggcaaggtactgcatggagtcctcattcatgttgctcatcttcatgttcatatcaaccgtgatgtccatggtctcctcgccctgggtcatggtcattttcattgtcgtatccatatccaaggatgtcagctccgagtttttcttaactgctgcgtcaaatacctctttcggatctgctttctttgcgcatgctgtcatggaaaataccataatggttgacatgatgactgctgctgtcttgatcatctttttcattgtttttctcctttttcctcacttttaaacggctattgccgtacagcccttcttttaccgaataagcatagcaacagtatagcattttttcatctgtcagacaattgactatatttaccttttaattaatattttacgactattttattacaacttcagtaatatcacaaaatttccggctgaaatttacgcagcagcgtacacgccccgggtgcagataccgcctgtcgcttctacttaatcggtgtgcggtaatcattcatgagttcatccgcattgtccgtcttaacaggctttaacgtatatgtgtactgataattctgatccgagggattcagatatttagtcagcggctttgctccccaggagttgtcgcctcccagccccatctgacgcatgttgatgcgcagtgtaatatcctggccttccggcagcatataggaatgaagggcattggtaagctgttccggcgtataggtaagagtattaaattctattggttttgccgccttcaccagaagcccggcgccctgatcattggtcaggctcacccatctgacatctgtgcggttccctgtttcctgcggcttaatataatcaatgaagaattcgtctacattcttacggtagactccaactccgtaaccggtctgacgatcaatataattttcttccggtcctcgtccgtaccaggtaatattggaaaaatctttcggaatcgtcagcatgtttcctatttcaggtatcattggcaggtccgcgcttcctggctttaatgtgctggtaatttccacatcgcctgttccgtataccgtatatacctgattgtatccggaggtggtgcgtgtaggaagctctgcgctcactgtaaatgtcacacgatccgtttcttttttcactgtcacgtccgtcactgtcctgtcttcacctgcatagcgccagtcggccatctccaactgagaataaaagcccaggtcactgtccgtaggcgcgcgccagaagttgggaacagggccgttctttatcaaatcaattccgttaaaccggaaggaatctatggtgcccgttttcttgttaaataccaggtcaaagtcttttccttccacattgaccgcagcatctgcctcttccacagtcagcggttccatttccgcttccgacgcatcagccttcggtacgttaaatggcagataaaattgttcctttgcaacctcatgtcctgcctttgcccaagaggtgtcttccttcagggtaaagcttacattgaggaaatattcagcccccggtttgaactcaggcgttgtaaaggctgcggtaagaatcccttcctccaaaggagcgatattcagttcctcaggcgcaaatataccggattgtattacttttccgtcctccatcagctcccaggacccattaaaccggttaaggtttgtaaataagtatttattctttgtgagtattttaccgttcatcacatcgccgttttccagaccgatattctgatacagtttttttacttccactaactcaggctgtactgtacggtcagctgatacaagcccgttagcacagaagttcttattattagggttccctgcgggtatatcctgccagtcaccgccgaagctgtaataagtcggctgcggatatgtcacatcctccgccccttcaaaatccagccatacaagtgcgttctcatccggtttgcgggaggtttttttaatctcatccggcgtcagcgccttattgtagatacgtacattgtcaatcaatcctttaaagaccggcggaacgtttggattctgtgcgtcataggttacatccgcgccgatgccgaccgcattgcctcccctggcgattccgtgggaatccttcgccgcggcaacctcttttccatccaggtacagcttcaggttctctccgtcaaatgttcccgcaatccggtgccactgtccggcccagttatcaggtgtgggaatggaggccgataccttggtataaacaccgtcgtcttcgttccactctgtgttgtagatataaaattcaagataatcctccaccggatctcctgtctcctgattaaagaatacttttctctgtaagccgtaggattcggtacacttccactcatcatttcctttggtgataattggtgttgaagccaccgtatcctcaggatatacatatgcctccagggtaaacggcatctttccggaaaaggccagcgctttgtcattgtagcagacagcatagcccttcattgcctttccttcatttccgccatcctccaggctgccttttaaagtaattgccagatctccagcgtcattcttaaggcgtttttccgccggaaccggcatctccacggtctgatccacccagtcccagataaaaccgccctgtaaaatcggatatttctcataaatatcccagtattctttcaagtttccaatgccgttgcccattgcgtgggcatattcgcactggagagccggcttggtaccgtaattgccccaccagaccagggggttggcagtcttgtccatcacatccggcttgttaacgcggcggtacatacgggaccagacgtcaacctccggtatatcccggtccccctcgtaatgtaccagacgtgacggatccagttccttgcagagacgtcccaaatcagcccaggtatcaccgttataggattcatttcccagggaccacaaaagaatgcttgggtgagtcttactgcgctcaatggtgctggtcatcctgtcccggcatgctttcatccactccggatcgctctggggtatataatcattcagcccgtgggactcaatattagcctcgtcaatcatataaaggccatattcgtcgcacagctcataccaccttggctcgttggggtaatgggaatttctcacggaattaatattgtgctgtttcatcagaagaatatcctgaatcatgctttcctccgtgatatgccttcccccctgcggttccgtctcatggcggttaactcccttgaacatgattggctgaccgttaatcacgacctgagcctggttagtcccgttattgataatggaaacctcccggaatcccacgttgcagccggcgctttccagaattgagccgccgctgtcctttaaagtcagcaccatctgataaagatttggttcctccgccgaccattttgcaggattgcttacggaaacctgttcagagatcactgcctcctctccatcaaatgtgacaggaagcgttttcctgaacacctctttcccgtccttatcaagcagcgcagtttccaaagtatgtccgcccccggcagactcgtcgaaacggcgcagcaccgcctcaatattcatcactgcatccacgtagctgtcatccagatccgtggtgtaattaaagtcaaaaatggaagcgccgcggtctttgctgtataaaaatacatctctgaaaataccgcttaagcggataaaatcctgatcctccagataacttccgtcagaccagcggtatacctgcaccgcaatcgtgttattttcaccggctgcatttaaatacgggctgatgttaaattctgcggctgtgtagctgtcctcactgtagcctgcatattcaccgttcacccatacataaaaagcggattccactccctggaaggagacaaaaacctccttgccgtcccagttctcaggcgttttaaagtccctgcggtaggagcctaccgggttatacaaagtcggggacacgcccagttccggaatttccactccttcccaaggcagcctggtatctgtgtatttcggataatcaaaaccttccgtctgccagttggaaggtacatcgatattgtcccatccgctgacatcgtagtccgtcctgtaaaattctgtgttcctctgatgagggctgtcaaccagttggaacttccaaattccgtttaaagactggtaaaaaggtgacttctccttctcccttaccctggcatcttcctcagatgcaaaggaaataaagctggtatgagccttttcccggttcacctcaaacgttcccctctgatcaaaccattcctctcctgcaaatacggacgcattaggatctggccctgcttctttgatggcggttgattcgccggagcttcccgaaccgtctccggagccgtctgctccccctacagtgctgcctgcctggctttcggcagccttttcatcctgcccactgttattcggagtctttgaacaccccgccactgatgaaatgccaaacacagcggccagagcaagacaaagcgtcgctttccgtttcttcatataaatcccctccacatttcttcggttaataatccactccgtcttacacctgcggccatatgtaaaaaaacgctcgccgcttcagtcataatgacggtgaattataccgatattattacgacattcatattgtatcaacataaatcaagagggtatataggaaataattggatgtatatacaaaaatatttatttatttcaaaaattcagaaaagcgcaaatttttacaaaattttcatctgttgtttcagatatatgctatttgggattaatcaggacgtatgggtagactttctgcacaaaaaaatacggcttccgaaaggaaaccgcatgatactttcttttataagagcgcgagacgggattcgaactctcccaatgtcgggaaagctactaaaatcaaggaggaacgcacactgtctaaggtgtgtctacaggctgtctacaacttagaaaacaaaatataatttccacaaaaaaatccaagtcaaagaagaatttgatacaatatctgaaaagtaaacagatattcaaacctatccgacatggaaaaagaatagaaagaagcggaaaacctgtcaagaatctgctgaaagcagacaacgcttgttcttgacaggtttttgtagtggctagaaaaatccccacgataggaaatggctggattagaagcattactttctaatccagccttgattacattatttgtcagaacttcgagccgccgtttatcattgcgttgaggaattcctcgcttcctctagttccttaaaaaatgcctcgtccgcctcttcaagttccttggcatatgctatgtcttcctctgtaatttccttgaaataccaatttttatttatgtaatcccaaactggataggttccttctggtgcagataaatagactatgtcataagaatcttcctctacgacagaacctgtccaacagcaaatcgaatataaatcctcgcagatatcttcttcacggtaacttgaaggagtaccttccataagaattggtgttccatataaatcagaagaacttaaatcactatcgtatgtcataccattcagaacaactcgattccaagagtgcggcccgttcggtgaatacccgtttacagaaacgcattgtaatccgacagaatcacacaacccttttgttaatgtagagtaatctgaacacacgcctttaccgtctctcaacgtaaaatgtatatgcggagttccatacttaaaatcgtaagttagaaaatcacatacttctttagctacagccttatagcgttctacttcatcagaaatggaatttatttcacctttatgctgttcaacccagtaccgtacttcggcttcagcttctgcatactcccaatacgaggacgaaaagggatgttcccgcttaagcgcagccttttccgtttcatcaagaatccaaatgtcttgtgcaaatactggtatagcagattctgctaaaatgatacctactgtcaatagtgtaacaattatttttttcacattcacaccccttctgaatgctagttgcgttttgatattactgtacccaaacaccatctgcatttacagtgtagccgtcaggggtcgtagtattagtaagcatatacccatcagcacccatataataccaaagtccgctatctggggattgataccatgtgtttgttaaataagtaccatcagcattttgaatccaccaacctttactgtcacttgcccatgttgaacttgcagtattcgttgaattatcgctggctactggtggcttccaatcatctgtaagttgatatgtataaatccattcggcattttttgtatagttatccactacaataagcataaatggcgtatctttaaattcaggcagactataagaggcagaccattctatagctgattctatcccatccggcaatatctggtattcttttccaaattccagtttttctgtcttattccattcagaatcatgaaacaaatagacccgcccatcaggaagtcggtttgctcccaaagacacccagtgaatttccatattatcagaagcactccaaccagaatttccactttctacagacacagtttcattcttgggaactacagaatagaaatctccaacgtttttagcatattctgcccagtcatctgtccgatatacagattccggtatctctgatggcttaacaacaggtttttgctcattgcagtcccaaccatagatccgttcagttccgccccacaaatcaggatatgttccagcacttacatctgcgtatgcagttagagttgcgccaatcataaatagcgctgatatgaatattgcaataactctttttggtaatctcataattacctacctccttaaaagtattttaattaataataccatattccattaatatacgcaagcgcgtatacgacagtgcgtaataaattatattctttttatatagtttttgaaaggatatatataatatgaacgcaaaagacgcaaccgcaaaaagaattgatattctctgtaaagaacgaggaattgcatataatgaattagcaaatatatgtggtttaacaccgtctacagtttacagtatttttgattccacgcgcaaaaacatcacactatctacaatcaaaaaaatatgcgatggttttgaaatcactttaggtgaattctttacccattccctttttgatacattagagcaagaaattaaataaacttcaagaatcatgaaattataaaaaatatattaaaaatctacttatagaaagattttgattgaacttttattcactttgtgttattctatatttatattataaatgaggtgattaatggctcaaaattagatttatttttttatctgttcagacttcaatgtctgtggaaagttcttaccctatatataggtaagaagaacgtgtaaatgcaactagcaaaggcatgttggtttttccactggcgtaggaagtcttttttgtttttactccttcccagtgttcaatcccgggaagtttttttatgcttaaatattccaaagttcaaacgcacttgaacgcgcgctcaaagtgctctgcgaggagcatgattatgagtaaaaaaaattataaagaacaggtagagaacagcccctactcaaaggaggcaaaggaaacaggttcacgcttatacaacttgcggacggaaaaaaggctaagcatggctgatgtttcggctcaagttgagagtgcacaaagagatgatgacaagcaagtcaaactttcaaaatcccaatatgctcggtatgaacttggtacggcttttatcaatacagaaaccgtatacgctctgtgtgagttctatcaaacttcaccagactttcttttacttgggaaaaagtctgatggaaaagaatctggtgattgcgatatcagtaatctgataggcccgataagtagcgaaaatctgcaatcattttgcgattttttagagaacctagccaacgttcttcgtgaaatcgcaaaaaataaatagattgaaaaaattttgccccgtataaattgcggggcatttttatggcacaaaacatcccataaaacctactgtaatcggtaaaaaaatggagtatcattaacacatcaaacaacacaacgcgcggcatgtttttgatgaatacaaaacaggaggtcataaataatgaaaccaagaacatttgcggatttaatctcaattatccgcaaagcccctaaaggagagtgttttccatttaagaatggtgtactccagacttatagcgacactccattccgtggaaatctctacctgaacaactgccctgctttgatttattttatctctgaatcaggcgaaatcagtttttctttttggagagatattccaccaagaatcagttgggagcgattttcatttaagggtaccgacagtatccagaaaatgacaatcaccgcgaatacctacgcgatcgcaccacaaattgttgcctaccttgacgaactattagaatatgtagaaaacggaggaatgctatatgttgaaaccatctgattttataatcactaatttttcagagttagcccagggacaaaccgccctgtgtgtgggagttcgcccttacaaggattacaaagatggcattgccggagatattggcggctatagctatgacattgtattgccgtttcggaaatacgaacatatttcaatgaaggtgcccggttctgccttgattaatcccgaactgttcagcacccccaacgccgttgtacccattgagcagattcagggtttttctgcccgttggtacaaaaccgccaacatgacagattattcgctgtcatgtaaggcttctggtttcacgatatcgaaggaggcaaaagcataattggaaaagtggttagaaaaattcgaccgcttgaccgatggagccgtggagggactgaaaaaagtcccttcacagctccgtaataacaaacggttgatatcgaaattaattttatttactttgattctagggttgggtctgatgtccgttatctgggttctgactgcatttgtaaaagccatagaatacctctatggaatctgggttgagaacacggagttgattatcatactctttgttagcctgtgcatgctcttaggttctatcacttcgcagataagtaaacaccgtgaagaaaaagagcgcagaaaacgggaagaactggcacgccagcaaaagaatgcctctacacaatatgcctacctgcgtcttttcctctataagattttagatgaaagactatgcactttagtagaggtggtgaaacctgttgcccccaacctgctgaatgctgtcaccccgataaccatagatgacaggcacgcaattatttactataattttcagcttcataaaacaaagaccctgccgttttcacaaggaaccgactacgttagcaacctaatttcctctcatgttatagcgaaaacgcaaatagagggaatagagggaatcacggcgcctgtaggggatagccttattactccagtgcatgtagattccgtaaaagaccttggttcaaccgctattatcgttttagttttggactgtgaagcatacagggaattaaaggaacagcaggggcattccttgcaatcccgtgaattagttgagcatatctaggaggtggcttatggtactcggatatagccttgtagattgggaagaatacggaataaagaccgcaattcatactgatatttgcaaaaatccccattccctgattacgggtaaatctggaagcggaaagtcgcagagttttctttggtatgcctatcatattttacaggagcaggaaagcattttgtatctggcagactttaaagctgggaaggaatatgctcccctgaaaggctgttccgcttattcctgtgctgataatgctgtttctatgatatacgactactacaagttatatacggaaatgcgacagcaccaaaatcccgagataggtcatgtgacgcttgccatcgaggaatggttcggatttttgtgcttcatggaaagcatagacaaaaagcaaaagaatgatttgatggcgaaggtcggagaaattctagcattaggacgagggattggaaatggaattggaatttttcttcttgtccaaagggcggacagttcaaacttttccgctggatcacgcgagcaatttcaaaaccttctctgcttcgggagacttagccgtgaacaacgtcttatgctgttcgccggcgaagatttagacaatacccggaactataaaaccggtcagggaatcactctgattgacgggcaggaaggggctacagaaattatcgtcccttggattcctgaacaagatatactgttaaaacgtatacgcaactatatggacaaacagccttcgttacaggaattgctacaccagatacagtcaaccggcggcgttgcggagcataagccataggttgaccggagcaggggcgaagccccttgctccataccgaagtcgcatagtattaccacgacttcggtgtcagtgtcaaaaatgtaagaaatcctttaatatcaatggttccggcatattccccgattgtgtcggctctgtgccggaacctagaaaggaagtaccatgacaaccaaaaagaaaaacattaataataatcggcgtagccgaaaataccaattaacatttaacaacccggaaaagcacaaaaattgttcccacccggcaatcaaggaaacgctgggtaaatgggaaaatacggtttactggtgtatgtgtgatgaagtagcaaaagcaccacatacccacttgtttatacaattcaagaatgcggtttatttttccagtattaagaaaaactttccatctgcacatatagaagaagcgcaaggaacggcggaagaaaaccgggcgtatatccgcaaagaaggcaagtgggaagatacggaaaagggaaccacgaatttaaaggatacctttgaggaatggggaaccatgccgcaaacgggacaggggcgaagaagcgatttagccaacctataccagatgattaaggacggctattccaatgtagagattctggaaatcaatcctgacaacctcctgaacctacagcacattgataaagcacgtttagagatacttgccagccgctacaaggcagaacggcgcatgaacctaatagtaacctatgtgagcggtgcaaccggctttggaaagtcaagatatatccttgataatcacggcgattccaatgtataccgggtaacggattataagcacccattcgacacctattccggggaagatgtgatagtctttgaagaatttagaagcgatctgcctataggcaatatgttgaactatcttgatatctaccctctgcaactccctgcaaggtacaacaaccggcaggcctgctataacttcgtgtatgtcgtttccaactggaagttagaagaccagtatcataatatccgcttggagcagacagagacatggaacgcccttatgcggcgtattcacaaggtgaggatatacacggctcccggtgaatggcaggaatatgacactactgattatctgcacggattccagccggttgacagggcagatacaccatttaataattaaatctggcaggcgttgggacttcacaatatacgctgataaaactactacaaaccaataaaactataacgaaaataatcatacttacaaataataaaatcataaaccatatcaaaattcagtctaacaattcccaaaataaaactttgctccctgcgcctgttgcaaggcggcgtatatgaatgacaacaaaaatacttcggaaatcttcaatctttctttattgaaagaagcacttgactgcggtataatcagtacagacagtgtgcttgatacgcttatgtcaacaaagagagaacaagtccgtaaaatacataattacgccatcacaccgccagcaaaagaaggcggacggtggcagacctgctataaagggtcagacggaaaaagaaagaatatcaaagcacaaacggaagatgaattattggataagttgattccgatatacttccaaaattcgcacattgacaaaatgaccttttacgaactgtatgaggaatggctggaatacaaacaaaccgtaaccaacagccctaataccaccaagcggcataaacagcattacagcaaatattttgaaccatctgccctacacaataagaaaatcaagaggatagatgaattactgctggaatcagaatgtaaccgcattgtaagggagtttaatctcccccgtaaagagtggggcaacatcaagacaatcttaaacggtatgtttgaatatgccatcaggaaaaaatatctgactgagaatcccatggacaaggttcagattcttgtcaagtttaagcaggtagtcagaaaaacaggtaaaacagaaacttataattctgatgaactgaatgacttaaaccagtatcttgaccgcatgtatacagaaacgcttgataccgcatttctggctgtcaaattaaatttcctgcttggcttacgtgttggggaattggttgccctgaaatgggacgattacatcaacatcaaccatctgcatattgtccgtgaagaagtcagaaatcaggttacaaaccaatatgaggtagtggaacatactaagacgaaccgtgacagattcgtggttctggttccaaaggcaatcaatatcctgcaaaagaccacgcgcaccggcgattacattttcatgagggacggggaacggcttacatcaaggcagattgcctatgtactggaaaaatatgcggagcgtcagggattgtctactaagtccacgcataagatgaggaagacatttgccagcaacctaaacgccagcggtgttcctctggattgtatacgtgaattgctgggacatagcaacttaaataccactcttggatatatctacaatccattgacggagaaagaaacctatgacctcatatctaaggctttgtaagctgtctacaactgtctacagcctgaaagacacacaaatatagcggaagtccttataaatcaaggcttccgctaccaataaaaagagcgcgagacgggactcgaaccataccgctatttctctatctggacagaatgagaagtgtctacaactgtctacaacattttggagaacgtaaaaggctgaaaccccttataaatcaaaggaatttcagcccatgcaaagagcgcgagacgggattcgaacccgttaaaccaaaaagcctgaaacccttgattttaaaggagtccagtaaatacaatactttacagccgcacaatcatgcggacaaccgcactgaaaaggtgttccgtgttgcattttgcacggtcatgcaacacgaatatgcaacacggaataaggcggccggatcgctcctggccacccttactaccccatcttttttcgtgccaaaagttcatcatatgatacacccaatacatcttttattgcctccaattgcgatgcatatatgtgctgtctgccaccttctattttcacatatgcctctctcgttatgggaagtccacgcaactgcatttctctcaccatatccttttgacggatttgtttcgctttgcgcaagtcgtggatatttttacctatattaatttctgtatcactctttattttctgctccattgtcacctcaaaaagaacccatattcgcacatttttactgattttaactttaaatcatgatacaatgggactaatatcagtccttttagtatggggcaattggtaaaaattatattcatgggagggcaagatgaagaagcttaagaatcgtattaaaaataatatcatgtactactggtccgttatcggccttgccgtaactggttcagtctgccgcattatccattatgtaaaaacagggcgattgccccacaaaaaaacaaagtacagccaagaggagattcggaaggaactgagaaagatcgctgaagaggtcgaaaaagaaaaagaggccccagctgagggtccggggcctgaagagtaggatatggcaaacccctcttctgtttataaaaacgattgaggggtttgattgtgacaaaatattacaaattttgcatattaaatttgcagattgatactttcttttgtttttggtatacttctcttagatgggggagcggtggcaagcccgccctcctctgttttccctaaagcctattctgtaggcttatttttattgctgtctttcggcctccttgattaccttttcgataatctcctttgccttatctgtgtttcctgtatctattaatgcttgtattgaatatagtaatgtcaaaagttcaagtcttgtcatttcttccatttttacctcctctctcctcttgcctggtaactcgttaaggacttgccttccttaactatctccattatactatacgtacgtaattttgtcaactgtttttatctattttctcctctattgcagacaaaataaatgcccttactgattgattgcatttctttgcagccggtgctatgacatcatcgtaatactctttttttacatccagtggaatcctctttaagtttttcttcgcatagctgatgctatactctttttgtttctcatcataagccatattttcacactccttcaactttagaatacctcattttcctctatacgtacataatcaaatttaccaaaattacgtacgaaacattgtgcatcttgtatatttacaattacgtacgtatagtatataatacgctcagaagttaagaaaacagtaaaaatgaccagcagctccgccccggaggtcacgaaggcagaaaggaacgttatgaatacacataggacagttaacggggtcagatatcacgtggttgatgatgcagacacgctgctctgtaagttgcaaaataaggctgatgattactactacgataatatgagatgcgacatagacaaggttgaatctgacatcgatgtgctggaaaaagcaatttctgaaaatgatatcaaaacaatggataagatgatatccgaatatcatcagttgtttaaaaggtaccagtaatcacattcacccgccccggccgggtaacgccgggagaaccatgctgaccctatcggcattacgggggcgggttagtgggcacgtcccgagagttcgccggtatcgtttccgtgaataacgagtgttctcacattccgggagtatgcgtgagagcgaaaggcgcaggcacaaaaacctgcatagcaggcgggtgaaagaccgccccgagagttgctggcttggcgcgctcaaagaggcacggttgcaacgtcatagcaggataaaggagggagattatgctggatagatacattgcaaaacagattatatttgctcaacttgcttcggacggaggcaagaaggacaaagaggtattaaaccgcatttcctcctttgtccctttatcagaagtgcattataagaaagggtatcacacaaagggtcactgtatcatcaatgcgatcagagcaatacagcgcaatccgcagagtggatttagataccacgtaaaagcggatcggacattatacagtggtgcgcatgtctttattgtctattttaactttaagataggagaggagcgctatcagatcagctttcatacatttgacaatatgtggcgctttgtcaaccagcaatgtgtcacgcgctggcaaaaaaagtatagcagcaaagaggcagtgataaagttagtttaccatgtatacaaataataaccgccccggtccgggaataggccgggagaaaggaaagaaccgtgtataaatatattaatataaccgagtaactttattttaaatttaatcgatatccctcttgacataccacccattgagtggtataataaatacataaacaagagataaacaatttctaataaaaaggagagacgaaaatgaaaaaagaatatgcagttaatatcgaatctgtaaacagtgatagagattggaacaccgccgatatggctgactggtacgattcttatgatgaagcgtatgacgcagcagaaaaagcattttctgacccggatgttatggaagcacatgtaagcatttgggaagacggagacgttgacggaaccccgttaaggatggttcgtgaagatggaaacgttcaccagtaccagggcgaaacaagattgtgggcataaaaagggaggggaagagatgttatataccacgtttattagactatgtgatgaagctgtcagacacgaaaacgccgaagagtttattatgaacctcggctggcaggaatggatgaaaaaagcagcagatgctgatgaaatcacaaaggatttgtcactgatttttgaacttgcaagcctggattttccgggcttgcgcaaaagacttgatgttagcatggcgaaaatgtcaacaatgtactggattccattacgttccatcgaaaattgggattccggcaaacgagaaataaaagactattatttaaatttcatccgatacacaatgtttgtccaggaaaaggagggggacgatggatacctcggctatattgcagaacaggattgatttctgcggtattattgttgcagaaagatgtaacccgaatggcgatccgattaatggaaatgtcccgcgacaagattttaacggaaatggaatcattactgatgtctgcttaaaacgaaagctaagagatcgcctttcagaaaatggatatgatgtttttgttgttaagcaagaagaactgctggatgaacagaaaagccttcacggcaaggtaaaggcggagtcagacatggttcgggctgcgaaatcaaaagataggactgcttaccgtaaaattgcctgtgaaaaatggattgatgtccgggcatttggtcaggtatttgctttcaaatcttccaaagcgtcaaaagaatccgaagaagaattaggtatatccgaatgtgtccggggacctgtttcaattcaagacgccgtatctctggattatataaccgtaatacagaaaaacttgacaaaatcagttaattcaaatgaccctaattcaaggtccgataagtcaagtgacacgatggggacccggtatcaaatcaattatggggcatatgtctttcgtggttcaatatatccacaactggcaaaaattacaggattcacgtatggtgatgcactggcaatcaaaaatgccatcataaatatgtttatgaatgatgcatctgccgcccggccagccggaagtatgactttggatagattatactggtgggaacataactgcccgaacggtcaatattctcctgtgaaagtctttcgcaccctgcaattttcgcctatggacgtacccccatattacaagacggaattgcttaatcttccaggattggaacctgaagtgatagaaggctggtaatattctataacatggcaagcccctcttttgcttataaaaaagcggttgaggggcttttaataatcatctttaaaataagcggaccagatgcacctggtccgcttttcaacttaacagaaacttccaatagcttaaatgaagtagttttttcaatccacgcccgaaacgggcgaacagcaactgttaagttgatattacgatacgcagagtatttaatactctggatttccttttattttaacattacagaaccgttttgtcaatgtgacaaaaatcagcaccaatcaatttttagatactgaagtacgcttaaattatgtaccttctggcaatctcgtcatactcagcaatctgtaattccccctggtcatccgttaccatacatttaccctcatttactcccttttccgggcaaaggtaatattttcgtccgtccggcgccgtctgataacctgtcagcatatatccggcagcatcaaacaaataccatgcagatgttcctgttgtaatctccgtcagccagtaccagccgctgtgtgcgtagctgccgtctttgtactgataccaccaacgttttccatcggccgcccgaataaagccttctcgataaatctcaggctctctcgcaaggctccaatcgggtaatccatatcccaggatacgggagtatgatttatcatatgactttgcgcagactccaccaccgttttcgaccacgcctgatgctccggaagtatttccctcgatagttttgaccttactggccgtcacctgcgtcacgataccagtgtgataggcacgtgtcccgttggtaaagaagataaccgctcccggctccggtgttttgctccaccggccggctgccttaaactggttaacccccgtcgggcaataatgatacaacgcgccgcccagcatctttttggccgtctccaggccaaaggcctgtacaaacacatctgacacatacatcgcacaccaaggctgcgcctggagattatgcccggtatgcttataatagtccctggcaaagcaggtgtaattattgctgccagcgttgtccgtaaaactgtccaggtctttattgctcttcttttccaggtatccattccatttcttcgccgtctgaatcaatttgtttactgcattttccatttacattcctctatttgtaaaaaggcccgggatttccccggggcctatgtactgttgttgcgacgtcgcaacaccggtataaccccaccggccggaagatgcaaggatcaccgcccctctatttctgcttgtcaccctgtccataatcgttgctgtcaatcttgtcctttaagaccgcgatatatttaagcagccaatccggcaccgcagcgcccattctgccagcgttttcaatgatagacagtaattcgttcagtaagtaccaaacggccaccagaaggccgaaaaacgcgtttgtcggcattgcaattccaaggcttccagataccctggctattacataatcaactaccatcgccacggcgatcacgcacagataaccaacctttttgatgatacctttagccccttttttgctgctccatccataccctttgtcgtccggatggtcaatagcctcggttttgctggcaagcatgcccgtgatgtagtctaagaccatcatccccattaaaacgcataatacggggtacaggattcccagcttgtcacttaaaaaagcgccggctgctgccaaggctccctgaattgcaattacgtattcctttttcattgtctgtctcctttacttcgccggattctctttcagccatttttcaacctgtggtttccaccacgtttgcacctcttccagcgtcatttctcctgctcttatttttaacccgtaaaatcttcccattatgacatccctcctgcttgttccgctagacttcctgcaagtttggctacatcattgatggccccgtcctgtacctgctgcccctcttcaactactgccacgcgctctgtaagccgttccacatccgttttaggacgcagactataagttgtcagtaccttaccgtcgggggccaccacggacgtttcagacaccagcacaaggtcggtataggttccgaccgtcagcccggcgccgtttttaatctgcacttgcgacaggttgtctggcctcaactgctgccaggtcgccagcatggcagcgcggtcaacggatgcgacctgcaaggcccccaagctagctccggcctccagggcgatctctgtaccgtcttttaaaatcagtttgtctttgttcattgtctatccttctttcttttttattttttgtatataaaaagagccctgaaggactcttgaattttctggttaaatggcgagatgataaaaactgccgatgccacatggtttgataatggtctgaaaattagtattattggaaccccaggggatgcaaattatcgtttatcattccaaagcaagaaaaacaatgtgtggtatggggacattttgtttgataggcatgattagccttcaattaacaatacaaaatggcgagataaaaatctcatacagaagctcagacgtaacgacggagtggatcataaaaaatccagtaagcataggcatcctaacaaaagctgttccaggatttgatttccccctggaatatacatggctttttatcgcaatttccgacggttggggggccggtatgctggtgtttccttacggccaggcaggtagtaatcttgttattggccagtacgacagagcatcccttaagtggagatggacaattaagtaacagccttcttctctcctaataaaatggcgaggctattaaatgcatgtttggaatatcagatcgagatttaaataatgccacacacccggggatatatttagtagactttggtgcttccagtgtaaaaaacggaccagatacaggagaatactttacgggagcgttatttattattagctctggcaactttctaattcagttgttttttgatggcaaccaatattttcgcaaaagattttataattcctggactgcttggattaaaaccactcgtgatttgtaatcattaaatggcgatctgaaaattaaattcctggacgtaacctgccagaaagggaaaacagagacagacgaattaaatgcatatgacaatatcgtaaccggtatggcatcaatgtcaaacaatgattatattatcgggtatatattgattaacgagagactaattatcaattcaacaaccgcacataccgtaagggtatattacatcaacgtccccaagggataaccaccagccagaatctgaaataacaatttaactgccaaaaccttacgcaaatttgcctgtttttcatcgcttgtccccagccgcaaaaaacattatgtcacctatcctattttggggtacaacaaataagccaccctctcggctgactaaaaaaatgctttccatcaccccttaggcagcatatttacggtaagattcccggacattatcctgtttgatattacagtaaatcaatgtcgtctctattttggtatgccccatcaagaccattacttcttcgattcgcattccgcgattcagcaagtcggttgcaaaggtccgacggaaccggtgtggatgcacattgccgactcctgcctttttccccaactgctttaccagatactgcactccagccactgttatacctgtatacggctttttcacggccgcaaacaagggcttctctgccaattcttctactgttagtccctctttttgcatcctttctttgaaataccggaacaggtggaagcatgccacgtctgatatgtacagatgtctctctttccggccctttcccatgactttaaactcctgtttatataaatcaatatcgcctacctttaagctacaaagctcactcaccctgacaccagttgcatataaaaattcaatcaacgccctatcccggctgcgggtacatgacagtctcaatgcctctatttcttttgccgaaaaggcttgttttatagtactttcaatacgtaaactttctattctggcaatcggattttccgataccatgttttctttttgcaggaatgtccagaaactgttaaggtatcgcatcctcccctgcagcgttaccatactgatattgttatgttctctcaacattccgaagtaccacctcaaatccatcgttgtaatgtcctcgatatttttattcaaggcgtttcggcagttgcttatttcccttacatactgggccagtgtattgttctgccggccggatacttttttactggcaacaaacaacctgattttagcagtatcgctatccgttccagttgcctgcagctcgtttttttcttccacaatttttttatcgtggaactggatataaagcacattttgaagcttatccaactgttcttcgtccagacagttactcatcgcctggacaacattcatcaacatttcctctaacactcaaaaacctccttcctgatatctctacaatatcaaaaaagaggttctttcgccctgatttttgtaagattttctcagctaaattgttattttgcattgttgtttaagataacgtaacgcttctccatccccgccaaacaaaatcgtacgaagttcgtactttcacttgtacgctatccctggatactccaaaggcaatttgggctttgtaaccatctatacctattgtaaggatattagcactgatgccatcaaacggcgcatgggatgccgtcgaataggaataggccaaggatgggctgggaaggtcgtttacatcgttacccgtatccaagcgtgtcacgtttagccatttatacagatcgccatttaacttagtaagcagattctcagctgcagtaagtcgatcccctagtgccttacccatcggaccggacagaactgtggatgtatctgttgccagaaggttatttacaatcttagcagcgtcaattttggccgaatcgagagactccagggctaagattgccgcgttcgctgcatccgtgacacgctttagtgcttgctccgcgtgatttagatttgtttcgtccaaatccggctccgaattatttacatatattgttgggacataagtttcaattggatttatgtttatactcatatttcctccttattcaaatttgacagaatgtaaaaacaatttaaaggtatcaaccgtaaatgatacgaacagactcaaataagcacttcttgatagcgcactaacatttatctccatagttctaatcgtacccgaagtatcttttttggtaatctccactgattgtgatgctatgctcaatctatccgttgcttgatatcttatatttttttcacgcgtaataaatgcttcaaaatgtgttgttgcgcttaccggcatgtagaccgaatattcaatcactaatttatttacatatgtcaggtcaatcggagcattaaaaacggaataaaccatgtttccaccactgctccccaacttaatggcgtgaaattccatatattttctatcttctatcctatctgccttatagcttccataatcgtaagcaatatagtctgatatggattgccctggagcgaatgtgccacgatagtaaaaagtctttgggtcagttacaatatatccttgccaggttccgggacccaccccacctacatattcgcccagcttaataatctcagggacaaggttgcttagcttgtccacgatgatattcccggtcatatacatgccgtctgtgtatacggtaatctgcttactgccaggggtaatatgtgtttcttccatcgtcgggatactttgtcgtacttctccgccatcatattttccggccggaagagtcaaccttccattcaaatcaatatacagcgtcggcgaacgccgatcctccatctcccccgcatgcacctggccgtcgggtcccacatataacttgcctttcaggacgtcgccaggcttcacatttaatttctcaaagtccgcgctctgtataatcatgtcaagtaatccatccgccatacttcatcactcctcatccggaaagccctgataggttccaacaatatctcccaccggcacaccatccttgattacctctggccgcaggttctcgacgctcattatgattgtgttggatgtcagcaccttgccaatgacgtttaacgtaatccctccggctcctgggtcgatcgtctgtcccgtttccgttttaactcccgtttgtcgaaacacatcttcgccaccatgatacccgggtacgatgttgtatctctcgttgatcgccatatcctttgtgattgcaggtattaccggcatagcaccttgttggggctctttgctgccggcgcccaaaaactttatcggctgtttaacatcggccggaaccgcagtcaggccagaattgtcgaaaccagctccatgctttaataagactccatcagccattacttacccctttcgcggacactgtaatactagttccaggttttttgctgtaacaatatgccgtcacccttccgtttccggatgcgatgcgatctatgtagccccaggccagtttctgggcctcaacagtcacgttgcttagggttccagtcagacgcaggccgtataccggtgtgtcagactcttttatccctgcaaaagaaactgtctgcgtatacggcgccgtgctgctccatccggaagcagaaaacgatagcaacgtctcccccacaaaggctccgacttgtgtctccaggttttggacgtcttccataatctcacttcggaacgccgtattgtccttatcaatagcgttgactgctctattggtggcgttaaaatcatcagccgaaaaaatatctccctcctgcgtgtagacagtgacatcgcgcagagatatagttccgtcttcattctggaccgtctgatattttcgatttccctgatagatatcattcttgtaattttctttcagactcacagtttcacctccctatttcccagcgcccgggtgccaaccttaaaatcaaaatgctgcatccccggagaagaccgttctaccagtacgccaatgtcatggataatctgttcgataaaattcgcctggtaaatggaggtatatgtgatgcgttccggagtttgcggcgtactggacggcgtgtaataggctgcccgtattgctgccagattgtcccgcagccgctccatctcactgtctgtccgtcgatcctctggcttccagtttactttgttgtgggtttcgtttcggtatccatactggtttaagacgtgggatacccacttgatcgccagctcgattcgatttaagtcctggtaatcaatgtaggccttcgtggtcatatcctgtacatcctgcaccgttctgtcatatataaggttgtctatatacttactcatggatagttacctccgcgcggatttctcgcaggctgaattgatagtcaatgctttccaacgtcccggttcttcggccatcatagccggtatcaacgcctaccacctggccaagcaccttatccgccagcagcacatcgccgaccacgttttctgcccgttgatagtattcatatacccggtttagtatctcctgggcgtttccagcgtgcaccaacgtcgcgtctgatacttctttaatatttttattaaaggcaatgttgggattttcccgtaacattgatgatgtcatgtgattgtattttttaccagtcagcactaccactgcaccggttccggccacaatggcatagttagcattgctctctatgatttccccgccggtaatagacaggctgtggtgtggatcagaaaagataatctctgccctgccagataaaacatcgttgtatagttcctccacctcctgcgtcggctgccaggagtgaacggtcagccgcacaccagtaaccacatcgttatgctccaacgtcagaccgtcaaaggtatcggcagtggaaaactccccacttaccgctgtctgctgtggatagattaagactccatcatagtttgatgtatcgaccacggcaccagccgcaaaagccagctgcacaagcgcgttgtgtttggtcgtgtaggggatatgaccatacaacgggacggaaacaagagtatcgtccaggaggtaattaaagtcctcaccagaaaacagttcctctagcacggctcccagctgctgtccggtgtaaataccgccgtggtactcgctgccgtccaggactccaatcgcgtcgtgcgtgtccatatagtaatccgtcttattttttctagccccattttttaaataaaaacttcccaatcgacggccattgaagaacaggttcagtttctgcttcttctggaaatcaaacgggatgttagaacgtgtccgggccgtgaatgtcatggtgttggtgctgacattttcagaaatggcgttgatttcctgttggcaggaaatttcgcttatttcatccccgaaaaactccctgtagattccgtaatcgattcgggtcacaaataccggccggcgtggcctggatgtctcaaggaaggcgattacaatcttgtcataagactgtacatagttgctacaaaaataccgttccgaatccggcgcgaactccatggacgacaacagttttccgtctgcataccattgcacattaatttttgtacaataatcacctgacatcaaattgaatgtaattaagataccaaccgaagtaaatttctggctgaataggacggtcagctccgggttacttaccttccgctccgacgttttggccggaaaaaagaatggtgctggccgaagcccgggccgtggatgcagaccgactgtggtgtacgtgtgcgaaaactgccggtcttcccctgacaattcgtcgctgatatatccatagtcggacgcattatccgggaagttgacatattccccgttcagcagggcgaaccgtggtgcgcaaatggaatatcccggataggtcaggtcatcccgttttaagtccgggaactcctggcggacagtcgttgcccgggggtataatttcgttcccgggtacagccccttcctgggccgcaggccaatgtcaatcacctgcggctgactgtgttccttggcatacggggctacgtcgtcatatacaattttaggcccttcgctattctcgatgacgtctgataatatggtctgttttagaaacatcttacggcctcctttgcggcgccatcgccacgaaatacacagacaagccgctccacagattctttccatcaatgcgtttcaagctgtccttcccctgcgttacgtaggccttaaactccagtgtttcctgaccatatgggaaaatcattcggtgggactcaaccggggcggagataatattgtaaaacgtgtcatagtccgcccggtgttccgactccggttcgacttccagcgtgtagttgtaaaacgttcctgcaacatccctatgcatactaaagtcctgcgtgcggccggagttttccgtgtcagtgaccgagaacccgcgctctagtttaatgacgttaacgcgaagttcaacgccatcaattgaaaatatgctttctctcatgcttatccctccgttaccagtcgaacaccgacacgctgcttctgctcgttgtttagcttatataccacccggccaagacgctggcggtcaagatacatgtttacttctatctgacgatttcctccgtctccacccatgtacttagccattacgttgtccagtgcctgttcaatcgtcgataacggcgagacaacctctgtctcgcgattgttgtcccccaggatagccgcaaactcgccggcgcgtggcggaaccacggtgccagtggccaggcgagggattgcctgcgtagccaaattatagccctgaccgatataactgctagctctactgctgtattcgctcgcgctgcttcccctcgtcagcgcacttatagcaattccgcctaatgtgattcctgctgcagctgcaacaataaatcccattgctttcatagtcggattcatcatgatactgcccaacgcgatagccaacaaaccaactgctcctgccacagcgatgattttcgtggccagtttttcttccggggtcattttatcccacgcttgggcgacaagcgctgccgaggtaataattagcccaagaagcagcgtcagggggtcaagttttccgattaggcctcccagcgtgccaatcaagtttggaagaaccgtcaacatattcttaacacccgttacaaattccacaaacttaaatgcggcaaaaaagcccaatattactgtggccattatttcaaccagttcttgattttctgatatccacccagaaaatttcttcaaccattctacaattttttcaatcgccttgataaatacctctcccgtccattttccaaacggctgtaaaaattcctcccacagccatattgccaatggtttcaacgcttctaacactgcgtcaaatgcgtccagtgctgccgctatcaaatcaaatgctgccggaagaccattttccagcccccacttagcaagcggaagaagaacatccttcaatagccataacagaatatcccctattttgcttacaattggccgacttgaaaccagaatcccgtcaaaagatttcagcagtggtgaaaaatccagcgtagccgaccatatcttaatctcccctgtcgcgtcgcggaagaatccggtcacctccaggagaaggtcacccagatgacgcataataagtagccctgtatccccgcttttccatgcctggtcaagcccatctgcaaggttcccaaccgtataaagcagatttgatacagaaatcaggacatcatccgtgatagcctttccatagccttccttttcccaaacagtcataaaagactggccaacatcatttccaagatttttcaatcgaccaagtgcaaattccgcagccgaaacaaccgtcgctccattttcatcccaagacttccgcatcgggtcgaacagacctgacagcactcctttaactgtctccgcaaaatccttgatatcagcctcaacctcgactgtctcaaacatctggtccggtgtcggagatttgtaagcatctgtatccacttttccgccctgcgcctgaatcaaatcatcaaaggcaaatgccagtttctttgtagccttttctttctctttcagttcgtcatttgtttcctttaaggatcctgcataatcctcctctacatccacagcctttacaaaggtgctttttccggtcaacgccgcgatgaactgcccggcgtaggtggccccggtagaaagcaggtctatcatttgtttcaaagccggtgcagctacctgtagaagtggcgcgaaggctgttgcaaagctgttattcaaacgtgtattagctgacatcagaagggatatgcttttgttcgtttcatccgaatatctggccaaattctgaaagccctcctgtgccgatttgatggcggctcgtagagacattcggataagcatcagtttgaacatattggacagcttcaggacactctttgttagcggaatagcttctttcctcatccgcttcatggaaccactcatcttactggcggatttaccggccttcttttgtgtattgtccaccccaatcagggattttttataagcctcagctgcctttttagccaatgcaagacccttgtatgccttgtcatactctgggtctcccaggccaagccctttttgctccgcataatacagagcatcctgataacggtccacttcgtcctgtaatgtccttgccttcgttcttgcactgtccatcgacgcgccggcacgttggaaaattgccacaatgttatccggaaagtgcttaaaggactccacggcgataagcaaagagtctttcagccctacaacagaattttcctctttctgggtttcggccgttacggtagccgatgcctgccttgccgattcctccagttcccgatttttcgcaatcatagcatcgacatcttgtccgtaaatattgtaccgcttcccatcatcgggaatggtagacgcaggggcattgttgtttgtaatcgttcctgtaaaagtcgcggctttctccttctgaagtcgctccatctcttctcttgtttttctggccgactcggccacctcatccacctgtcgggccgtcgccgctgcggcagaaccggaagacgaaaaggccttatccatttttgttgacaggttatcaatcgccgccgtaagcttttccgctgcctttaaaaggctgcctgtgccttcttcgaatccgtcggtatttatcttcgtgtcaaactttaaacttccgtcagttccgccagctgccatactatcacctctcctccgggcataaaataagacgcctgttcagcgccttaacccaataacttattccaataatcaatttcttcctgttcctcggctgtgtatttcttcttcaaatcacacagggccttgttattgcggtaaaattcctgctcccacttctctagcttctttcccttggctcttttctgtcgaatgccaaggaccatagaaaaagtcccgtcgtcaatctccataaaatagcccatgaacgtccaccagtgcatgtactccacagccctgacttcccggccggccaccttgttgaccgcagggaataccagactctcgtcctgctcccaatccattaccttgaccggaggccgcttatcatcctcctgctgcccgcaatccagaaaccacagcccctgcttaattgcttcttccgttgcttccatcggtatgctgtccaggtcttcatatagaatcatcagcattacatcatatttctcagccggctgcagctccgggtcagcgaatgcctgcatgatgaccagcatatcccggaaatctgtccggatctttcgctcttcaccggccacctccaaggtcgtcggaagccggccaatcattttctatacccctccgtgtacttctcaacccgggcttggctggcggagctgaaagcttctatttcctcttcgataatcggcgttacagactgtagcactgcttcaaaaagaaacatcttttctttcccaactgtacacaagggggactggccagaaaagattgtgtcgtagacatcagcattgaacacatagttcaattcacgacgaagcacgtcctcaaaacctctcagttcggcggattcctcttcgtcctccactaccagtgttccatccggattaagttcgattgcctttaagcttccttcccatttccggatgcgtttctgtgcctcctcgacgcgaacacgcatgttcaagtcaccggggttgaaccggattacccggttttcgtccccattgatacaaaatgacttaaatccatcatcaaaattaatactgcgcatacattacctccttatgctccgaccccagaatcggctgtaaatgtctttgtagcaagtacaaacttgccactaaccctgtttccagtgtggtgcacgttaaatggaatctgataccccgtcgtatctccgccatagctggacacttcgatgatggcatcctccttgtaggccacataggtaccttccgctgattcaactggttcccaaagatgtacctccaccacactggtcttaagttcatccagcgtttgacgtttgtctacaatggcctgcagccgtacaaacaatgggtctccgacttctgcgtaatatggatccgtggaagcctgtggctgatagctgtcaagggtaaccgatgtctcacccaaaatattatttttggtctccacgtttgcattcatttctaccgtgtattcttccagatctttcccaagtcgggaatattcggctttactagccgatggaagcgcagaatcaatataatgtgccataaattttcgtttgattttacccgttacatccggcatttataattcctcactttctattttgtattgggcgtatatctgtatctgatacatgacgccctgctctatggtttctcccatcagtcccatgctcatggcattggccgtggacactttcataaatttccccagaaactcccgattctccaccgtgccggatatgccttcctcttccggcagtcgttctagccagtaagccagctccaggagaaaattactgttggccaaccggttataatccgtaaatgattggccaaccgcatacatgacaaaattatgctgccgtatctggtttcccagcaaatcctccttgaccaggctgtctccggtactggacaggccataattgacgggggaagggtccgtgaagtcgatgtgaatgtcatcgccagccagaaactctgatattttcggatattccgtcagtttctgcctcataaaatctatgattgtcaattacttccctcctctgtctatcaatgcctgcgccgcttggatgatatcttccctatggtcggctttcatgcgttcgaagaattccttgcctcgcatcggcgcgcctgcataagtcagctctcgctccgccggtactttaatttcattcttctttgcccaggagctgcctgtcgtcggagacacgtacaatatacctttgtgcaaataatgggcatatggtcccggaatgtctatctgtccggagccgatgacggtggacagtaccatcatgtgttccaattctcctgcctgacggcgcggcatataatcacccatataccgcatagtctcgctgtctatcaccttctgcactggtccgcctggctggattccgtggtttttcaggataaagtttgttgatttaagctccagacttccgttaaacacctcgccgcctccttacttacaggacagcccataatgctgcatcgactcgctgccatacaaccgctcatctaccgtagttaccgttagcagctcatgcgctgcttttaaggccgccagtgactttgacatggcctcctggctgttacagtcaatctcgtctgtaacaattcccttgataacaaggtcttttcccctcgtgaaattaaccggctcagacaggctttccagaggaataaccagaagtacggagcaggcgttccgctgtccggtcttcaggaaggtggcctgctccacatcctcccagtacactcctccaacagggaacctggtgtatttctcgttctttccttccttgctgtacagatacagcgtgcaatctgcgttggtatacatattacaccccctgataacacagaccggtatcagccagccacttcatgatgatttcccgctgttcccggccggaagctgcagctaactcctgagcggaaccgaagctgacagagtaggttccaatcctctcggcagccttcccgccagattctttcagctgcctctccctgcggaattctgcctcggctagttcacaacaacacatctgtacttcttccgaagcctctgacgcatctttcaggcggttaaatgtgtactggtcaatcaaccgactggcctgacgggcgtaaaataggaagccggtgctgatgactggcttccgtcccaggagatagctttctctgtaaaatgtttcattggcataagtcatcagcacaccttcctttctactgcttaatcagtgtaaccgtcttttccactggtgctgcttccacagttacagtctcagtgattgtgccatatccagtcttcttaatcttcgctggatatgttcccgcgcgaaggttaaattctgccacacctgatgtattagttttaattctagatccatttacgtctacaatcgcgcctgcaattgctgtagatgattcatctttgtcttttactgtaaatgtaactttctgggttgttaccgctgtagacggttccaggtaagcaaacgggcagcctacacggtcttcgtccatcctggttgccgggtttggaagcgcccatcccatacggaatacgatacgcagtgcaaccatatcctgctgtgccaggttatagacgatttctttcgtagtcgggtcctgaatgacaccctggtccagaatctttaccgtcacatcctgacggatggaatataccgcctgcttgaagtcaccaacaatcagctgagcgatagtattgtcataagcaccattctgagggaagtacatcggtgccccatccaacgcatagtttgttgaaccctgcatatcggatttaaaaatcaggctgccgtccgttgcgcggatccccctcagcttggccctcatactcatggcagccaaagctccggttgccataaagccgtcctcctcgactttggaaataacgcctccttcgcccaggagcagattgtaataatctggattggatccgactgccacattatttcccgcctgtctggccagtgtgataatatcgttctgccagttacgcggacggttcacaccgaaaataatagcgctgtccactcgctggccgatcgcctcgttgactcttggagtaatctccccgaaaatgtcgaactccgcatcgtccagcacagcctccggaatcggcacaataactgccagctcggcggcttcgatgaatacgttgtcccatgcctggcggctggtctgcttcattcctgtatccccatccacccaataagccgttggcaggaagtcaagaaccctcatgcgggtctggttgctggtcatattcggcagcttacgcgccatgctcatgaatgtggactgcttcggtgcgtcctgaaaaatagttgaaataacctgttcgcggataatggcctccgcgtcggctctgcttgtaatatatactgccatatattgtttacctccttattctctgcccaagatacttctcagggcattgtttgcttgtgtccttgtatcgtctgttttttctccgccaggccccggagtgggtgcaaccactctcggaattgtgacatcctgaaaaaggtacccgttgtccttttttacagcctctaaggccgctttgatatcactttcctggttcttgctggatttcagtttttccacgtccaggaaaggcataacagctctgatatccctaggcttaaatccttccgccgtggatttcagcaagtcattaaagtctcggtctgccaactgctttttatactctgcctctctggttgcaaggtcgtttgtaagcgttgtcactttcgtttgcagctctgatatatttacgccctcaaagcttttcagcgttgactgcgccgtctccagctgccccttgtaagtatcccgctcctgtttgatggcctcgatatcattgccattctcggccataatgctgtctacctgctctttcgccaggcccatgtcctctaaaaatttacgtttcatattgctcctttctcactacgcttttctacggggttgcatcccttgtggtggtagttttacgccgttccgggcaattttgggcgtaaaaatagcacccagggtagtcccgcgtgcttactcctctttgtggcaaatatttgtcagtttcttgtacacatcttcatacaattcttgcttatcgccgttaaacgtatattcagcatagattccatctccgcttattgtcgtagatgcaagacacttataattctgtaaagtcttgcatgaccaaacaataaatacatcgcccaagtcaatttcaacccctggtctattttttctataccactcaaccaatttcttctggcatacattttcaaaatgcttcattcctgtaataatcatataatcctctctttccgttgcgatatcgcaactttttactttggaatcctcagccgctccctctgttgccgcatgtccatctccttagagaaatccacataagccttattggtcagtctcaaccgacacttggcagccgttatatcatccttatcagctcccgccttctccaggagttccacgtcctgtttctgcttccggatggttcgctctaacttccgctgatactgcaatgcgctataggtgtcatactccttcccccggaatgttttcttctcattctctttccggttctgttccgccaaccactcatccgtatacttccgctttgatatcccaggcaggaaggggaacttaatatgatagcagttaatgcctgcgaaacctagcatctcaccctcgccgcagacagtccgcatctcctcagaactgtataccttgccttgccagctctggtgattaaggtacccagtacctgtgttcctggcgcccatgtgccagtctacctcccaatggtccgtccccagctcctcagcgttcttgtcgctgacctgtttggtcatctgggccacaccggtcatcactgcacgcctggctgccacctctatgcggtctgacttcccggatgcataatccacagtccggatgccgctggccgtcatctcgtcaatcacctcacctatggcctggctgtacgtcctggtgccggtagtgattccaagcattgccttatccaggctgcgctccagatattcggacagtggcgtaaatactttctttccaccgcccatcggcacattaaaacccgttgtctgggtgatattttccaatggcctcaagctgtccttggtctgccgcctggcagcatccacaacctgctgcagccattggttgtcctcatatggctgatagtcaacaccggcagcctcatatatctctcggttgcggatgtaatcagatcgagcagcctgcttgtagatatcatccacctgcagtccagcttgtttgatggcctcctcaatcatccgtttgattttggacttactaacgccgattgcggtaagtcggttcaacatccagtccgttaccggagtaatctgtgcggatgccttgatgcgctgtacaatctcattcataattgacagctccagggttgtcatggttcgctcaatcggttttggcagcttctccagctcttctggcgtcatttacatcactcctccgtcagtgccggttccggcaggttcttggccgcctcttccagcgtttccccataccacttagcgcggtactcatccagcctcatgactcccatcgccacgtcattacgatcctgatttcggtcttcttcggtatctactatgacgctgtcatcccagtcaaaagacacctcgtagtttccaccggctggaactaatccataaagttccgcccaaaagcgcatcgcatacaccagatcctctaacgcatcttgcaatgccatctgcgtgtctgataccatcacgtaggatcgctgcttgctggtcttgatttccgtggctgtcttgtccacgctttgcgggtcagacaacgttccatatgccaggcagcagttaaattccactaatttcagctgattattaaagccattgaacagcgcagtgtctcggatttcaggagaaaaggtatcaatgaatggtttatcagcagcacccgtgttatattccagattccggtataggcgctcctttcctccggggtattcaaatttatcacgatcccggttgtacttaagcagcgacgtcgcgatgtgtaccgcaagctgtgtgccttcgtattcccagcagatgttcgaatatcgtttgtctgcctcattaatcaggccaatcgcccgagaatacaccgatacaccaagcggactgtcggaatcgtcagcattcgcaagcggtaccttaaaatatccaaacagcagacggtccgccccttccaatgtgacctccggtgccagttctgaccatcggtcaatgctgttgactgacacttcgctaccaaggctgtagtcgttggtagccacgaatgcccggtttataatccggattctcccggcctgcatggagtgaatctctaatcgggtatatatcttctttcctttccgaaactgttccgtaaatacgcactgtgtaatccggctggaactatcgaatgagatagggaagaagcaatcggcctgaacgaactgcacttcgataccgtgttgggtgatatacggcttcatgaccaggccgcccttggcacatccatattcaacataccgccgtatacttttcaggacttttcgcttatattgttcatccagatacccggagtcattcccacctgtgatttctgatttcatttctagtgtcaccagtcgggccagctccgacgcgatagccggtgccaggtttgcactgaacacatccttgttgttcacccagggggaccggttctcatacatccgggtccacagctctatctggttcgccatccgggatgtcaggcacacatccacctgcgtgtccgcatccttattcaggacattcgtgattaagtccagcatctttgtgaatctcatcgtcccatcacctcctatccatactttatgagcctgctaatctgccgttcaaacgtatactcaaagctgtccaggctgtcaatatcgcttgtaccatcatctaaccggacattcttcgtcaattcctttgggtcccacactgcagtactcaatgcatccacaaggctctggcactcgccctggacataataaaaacgcccctgggccatcaggatggcggtagcgttaatcctgtcattgatttcagttttcagggcattctctacacggacccacccaagtccatgtttacgcaggctgctccggatgccagctatcagcgtctgctctgcgctgtctgcatacactgttgtgatgtacccgtgcctgctgattatcttctggcagaagttacagaacattgtccccagcatttcggggtcaatctctatctggttccccttctcatccttgcaaccaatccattctgatgccagtgcaaccacgttatggtatcccctggtgatggccgtggccgtgaaggcatggccggaaccactgccgccgaagtcaatgccaaggataatctccatgatgtctttgggcttatctgtcaggcggaacgcgtactgcctggtacttgtgtcgtcagcaaaccggcggtagatgaggccattggccaccacgcgcattcccttgatgtcccggaggtaccagatactgtttttatcataccggctttcgacctcccgcagacgctccggggtgatgttgatgttgtcgtagatggtacagtgcatgtagttgtatccacccgggaagtcccctgcatccgcctgtcgctgatacttgtctatatactccgcatagatgggcgcccttgggttatcagggttcaggtcccagaacaccttcaggcgccgggcagccagctgacggttgaatgcctccttgatggtgttatcgtgatgcaggttaatctcagttgcaatccacataccgtaggagtttccacgaatcttcttgtagctatcttccttggcggctcccgcaaagattactatcttctgttttccccttgtgtccgggcccttgataaacagcgcctcattgtctttgtacttcccccagtggcattgcccccggaatatccactcaagcccaaagccattggcatcaccaatgttaagcttcgcattggccatagtggaaccggtagccaggtgaatccggtccggtgtggttttaaactcatgggcgaaggcaaacacgttatccactgtcttgccggcacggaccgcaccctccgccacgttatacatgcaggcctcgcacctacgtatataatccttgtgcttctcggaaaagttgaatgggatggtctttttcctgacaaaactatttactgccgccatagatatccccctctatcccctccatgtcctccagctcctggttgttcccagttaacttatccgtctgggcccggagctgtgcaattcttgctttttgctcctcgccggccagttcccagttcttgtgcaggagctcgtcatattgcttgatgagcccttccagcgtcttctgggctctggcctgcgcctgcaggaaattgccatgcttatcccaggcctgctgtacttcccggcgctcctctgtgaccgtctccccattcttatggcctatcttagtgatggtcacgtccttctggtccctcacatacatgatggactgtgcccggatgatggcggcataggctatctgtacctggtcccagagaatgtccagcgggtccgtgggcatctcctggatgatggaaacggtctcctccggaagatatttcgaaaagaaaccgtatttttctgcgttcttatttaggtcaggggcgccaccttcattcccaacagcgttctggttaccgggctggcctcccttctttctttgcgaacgttcgcttttcttatccgaacgttcgttgtcccatttgtgtgtacacttccagcggcggaccgtcccctctggcaaatttagttgacttgcaatctcaactaatttcctgccttccaggtacatggccttcgcctgctcaattcgtggatctggcgctcgggccatgtttctcacctcatttcgtgttgttttgggtatagaaaaagagccacgggtgggtggctcctggttctagctataatatatctactttaaagttgtcagtccttcttgttcttttcaatagcactaatggtgcaagcaaaacctgtaatcattgaaagtagtattgctccacccattgcttcgttcattccagcaccaaagaaaaaaccgaccaccgccgcaattaccataagaatgattgaaatcattactctcataatatatacctccataacttagaattttctactcttatcaataaccccaagtcatcagattccattctccaccttcactccgtgcaagccaccatgaccaagtgtattcttcgttagcctcccatgcaccgccaccttttttcggcgaacgaaaactgctttcaaatgcaatacattgcgtaaaggcttctttattatcatccgttcttaaatcgttcatccattcaatgttatctgcattgttgcattcttcatccggcatataagaaaggctatgcaattcacagccctcaaacgaagcgaactgcttttttataatctcaatggcagaatctatttcttcttttgaataaacggaagatgctccataatcaatttccacttttgatgtatcaccgttctttccgcatccggcaaagagaagaaccagcacaatgcaaagcgttacggttataatctttttcatagtgaatacctccaacttccgatttctcattgacttcattatactttattcgaccctcaaagtacagagagattttgtaaaacttgtcgcctgggaacagcttgcaacgcaaggtgtccccagacggcaagtccacaaaagggtagctggcggcagccagcgcaggggaagcgtagcgtctcctgtatgatttggagcagaccatgactgcggaaaatcacagccctccggcgaggagccttcggagaacgcaatgcaccaacctctgggtggtgtataattgcgcccttagtaaactaaggggtttccggcttcttccgttccagcagttttttcaatagttcctgcgtgtcctgtctgtgaaaaatgaatttcaacaacagcatgacatcatcatctgtcaggcgttccggctcttgcagaaaactttccagcataccgccacgagtgcagagccggtgcgtccgttcctttcgggtaagctgctttaactggtgctgcaatgccttttcatcattgatggctttccgcagtttcttttcgcttttctccagctcccggttgagcttttccagctttgaagtatcaggcaagggcagcgtcctcctttcccggtatcagcacataaatcctgtttggttctccaatgccatgacgcacccgcatgataagtccggcggtttccagttcattcaaagaacgcttgaccgtcatggggctgcgggacaggactgtggcaatggctgtgatagggaagcagacaaacagaattccgttctcgtcctcctgccctttggagcgcatagcgtccagcatccggcagtacatgacctttgcggtgctgctgactggaaatcctgtcaacgctatgggaaatggcatacacggcggcaatggtgtgtctatcgtcataaattcaaaattcattcggtgtgttcctcctttttctttgctcgtttggataaataacgggggcagtcaaccacaaccgtccggaagctctgcctgcacccatgctggcatttcctgcataattcgttgtaagtgacacgcccccggtcattgaggtaaaaggaaagctcatgcttcctctttttgctcattctcggcatattgcacttcctcccgtttttgtgtatggtttcggggcgattttcggaaaaattacagccatagagccgcctaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtatgctcgttttggtcagggttcctccatatccctgccaaaagtcatggcactacatcgccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgtcagaaagggggaactgcttcaatgaacggagctactacaatacaggaacggctaaaagatttacgattaaacaaaggattaaaactggaagaactggcagagcaaacgggtatttcaaaatcggctcttggcagttatgaaaaagatgactataaggaaatcaatcatggcaaccttatcctgctggcagatttttatgaggtgtccctcgattatctcttttgccggacagagaaccgggcggagatcaacacgccattaagggagctgcatttgagtgatgagatggtagcacttctgaaaagcggtcggattaacaaccgtctgctgtgtgaacttgccacccataaggactttatcaagtttcttgcggacattgagatttatgtggatggaattgccaccatgcagattcagaacctcaacgcccttgtcgataccgtccggcatgaaatcattgaacggtatcgccccggcgaagatgacccacatttgaaagtgttgcaagccgtccatatcagtgatgatgaatatttcagccacatggttctggatgacctcaacctcattatccgggatattcgggaagctcacaaaaaagacagcgaaagtgctccccagaccaccgttgccgatgaactgaaagaaaatctggaagcggtcgaaaatttcaagggcagccgtttggaaaaactggcaatgctttactgcaagcaactcggtatcaactacaaaaatttatcggaagaagaatttcgctggctgattcggattctccaaaaatcaaagaaaatgggaacacctatcagccagaggaaaaaacggtaacaaaaaaccgctgttgcatggttgtgttggcttccatgtagcagcggtttgtgctgtggttattcagttgaaattttgaagtggtaagttgtatattataatttcatattaccatggaaaaacaaagtaaaataccaaagcactaattaccgaagcgattagaaaaagcttcttactttttgcttttttatagaacatgaaaagaaaaattagcactcctattacatccatcaataactgaaataggaatgtatgatgccctaaaaagtaaataaaaattacaattgcttctgcggctaaagcacctactggcagagaatataatatagaattaaaaatatgttctttattccagtaatataagataaacgctgctattgcacaagggattgaacaaatagtaaataatataaatagtgaagtacgaaaaccaccagaaaataaaggtatgaatgttcctaatattgcttgtaatccatagaaactcaatgtcattccaaacatatataaaaacgaactaatccctgcacaaatgtttgaagtacttgctaaaacaatgatggtattggtaataatccaaaatcccaatagtgtttgaattgacgaaaaactccataatgtatcagctgggcaataatctgtaagcctgcaaatacatccgactaaaataccaaccaaaaaaattgttatataggatttcatactatgggttaaggttttgttcataaatttcctctccttcagctttcagtttgtaattgtcattctgacataccgtttatgaataaaccatctcatgcaaaataatttcttctgcccggttgtgaatgttattgcaacgctgcacccattccatttgagaagtacgcttcaattcctcagtcacgccctcggcagctttcatctgctccatgatggtgtctaaccgttcctgtgcctgttcgttcaggtctgcaaggtatgtccataacttcccggtcagtgtcaatgtgttcaatctggctgggtggacttctcttaaatattcccggtgcatccgtccgtactttccgatagggcggtgttcctccggcagcttcaaatctgggatataataatccccaacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatattcgttgtcataccggcggcaagccttaaatcctctttcctcatatcacgctctaacagtgtgtgccagagtggtttatagctgatgtgcatattgttttcctgcctttctatccataccaccggggcggctgccccggcaggaacttttctcttattatagcaccaatcttgtgtaatcacaatttattcttgtagactgccgctgataccgtctggattggtttttcctttctttttgttccctttaatcagccatgaactgcttcatgccctggctctttgctgatgtgtgataaagaagtaatagaagtgcaaaaaattttgccgttcctatccggcacttagctcttgtgtcggataggtcgggcggttattcgggcaagtccaccttgccaacaaaagaataataaatctcaatgtcctgcctacgggtcttgttctcgtcatagctgcactcatgcacaacgattttctctacaaactcccgcagcagagtaggggtaagttcttcaaagctggtatgccgccggacaacattcataaacttttctgcgttcacggtggcttcctgtgctttggaaagctccgcttggatagcggcggctttttctttcagttcccgttgctctgcttcatagtctgccgacagctctgtgaaacgctcgtctgatatgcgcccggtcacgctgtcctcatacagccgcttgaagatagcggataactcggctatgcgtttctcggcggcttccagttcctttttcttggcggcgttcctgcgcttgcccccgtcctcgttctgctcaatcaagagcttcataaaccgggcttcatgctttgccgcatagcttgtcactttccgcagattggagagtacaccagcagtcaaaaggtcggtgcggataaagtgcgccgtacagtcatgggtgcgtttcttgtagttgccgcagatataacagtcctgcttgcgcttgtccgtctggtatcgctgctgatacatcacactgccgcagtctgcacagaacagtatgccggagaacaagcccacttcatcatagcggttggggcgtttgcgctgcttgcgaagttcctgcacccgttcccatgtctgggtgtctatgataggctcgtggtggttctcgaatatcgcttgcttttcctccgggttttctacgctgtgcttgactttgtaagagagtttttccgtcttgaagtttaccagacagcccgtgtattcccggttttcaaggatatgcacaacggtattggtcgcccacttgcactcatagccgaggtggtagcggcgggtgctgcccgtcctgcggtattccagcgtccccggcgtggggatctgctgctctgtgagcatacgggctatcttggtcggaccgttcccggcaaggcagaggttgtatatctgcttgactacgggtgcggcttcctcgtcaatgatgaaattttcgtcctcgtccatgaggtagccatacacaggtttgcttgtgatgggcttgccactcatgccttttgagcgtttcactgctttgattttcttgctcgtatctctcaccagccattcgttaaagatattccgcagcggggcaaagtcattgtcgccctgtgcgctgtccactccgtcattgatagcgatgaagcggacacctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgctttgcataggtttcaagaatacgcttctggttggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggcgactgtctgtatagcgatttctgcttctttaccgcctgtcaaaatgacgattttttactgtgcggcttctcgctgcaaaaaagatagaaaagttcataactctgtgatatactttaccgtaaatacacatcagacattgcaggagagaaaatgaaaactatattacttcatggattagggcaaacatcatcaagctggaaaaatacgattaacactatggggaaaagtgcggacattttatgcccgaacctttttgattggtttgaagataaagaggtctgctatcaagttttatatcttgctttctccgaatactgtaagcaattttcagaaccggtcaatatctgtgggctatctttaggcggtattctcgcattgcaatatgggattgaaaatccagataaaataaactctttggcgttggttgcgacacaatatacaatgccgaaaaaactcttgcaatttcaaaatatgctctttcggtttatgcctaaaagaacatttgaaagcatgggacttggtaaaacggattttatcaatctgtcaaaatccatgataaacttggatttccaaaaagaattgaagtgtatcaatagccctgtaatggttatctgcggggagaaagatgcagcaaataaacaggcttctttacagcttcaatcgcagttaccacaagccgaattattagtgattaaaaattctggacatgaagtaaacatagacgctcccgaagatttggggaaagcactctccgcatttttcaacctataatttctccgccagcggtcacgccaaaagcgtgaccgcttttcagtatcatgttaaatcaccgttttttgtgtagcagtttccgcttccagcactttcatcatcttgtcggctgcggtggctgtggtatctttcttgaaaaagccggacacaacaagcacggtgttacccatgcggatctccgtcacgcagtccgggcggcggtcggtgcggtcattgttattctgtttgttttctgtcataggcaactcctttcacttcaacagttcttttagtccattgagcttggcttgtgccgtttcctttcggaagttcttgcctgtaaagaggataggcagacacatttcaagcactcggtcatagatacgggcgtgggcggtgtcctgtggattctgcagttccgtaaggcttagattggtggtgacaatcagcggctttcggctgcggtatcggctgtcaattacattgtagacctgttccaaaccatactctgtgccacgctccataccaaaatcatcaagtatcagcagagggaaacggcaaagatgctcgatatattcgtttcgcccctcaaagctggcagttaaatcattcagtatcgcagaaaagtttgtcatgcggacggagatttcctgttccataagggcattggcaatgcacccggcaaaatagctttttcctgtgcctaccttgccccacaagagcagaccatagttgttttctctcatctgctcccaatgctccacatataaatgtgccttgctcatctgcgggcatttgccgttgtcatgtgcaaaagtccattcctgcatggtgaggtcggtaaagccccggcgtttcagttccataacggtgttaaggtgtcgtctgcgttcctcggcggattcacattccaaacgcttctcccgttggcagtcacattctgtcgggtgcttgtcatgccccaaccatgcggcggtttctttgggaaagtaggcttctttcgccgtgcggcacttgctgcagtaaagcagaccgtcctcgcccgtgtagtcctccggctctgcggtagtagtcatcatattcaaaacggtatcggtaaaaagttcagtcataaactctcgccctccttaaaggtgtaatcgggtatgccttttttcggcggtttcttggcttcgtcctcctgcgcccacttgtatatcgtggctgcatgactgcggtatttcgttcctttggacgctatatgagtagataagcggtcaatataatactcccatttgtcgggcagttccgctttcagctcgtccagttccgtatcggaaagaaaaacattgttgtatctgccatagctgcgggcgggggcttgtcccgtttctaactctctctctttttctatctctatatctatctctttctttatctctatctctggtggacgaatgtcggacaaatgtccgccgtttgtccggggtggtggcaaagccttgtttgcaagccttgccgcccgttttcgttccgcttcggtagaggattgccctatcatcagttcaatatcggtcatgtagagcaagccgccgtgtagctgctccacaagccccaactgctgaaaaatccctaacgcccgttccaccgtgcctacctgctgacgggtaagagtggcgatcatctgtgctgtgtaagggatattctcgtcaagctgcaacttgccgccgtttttcagcgattttaagtacagcttcaagagaatgttggaatagagaataccgtccggcatactctccaacagcacgatagcgtcatcatcaaaatagctttctttcagtttgaggtagtaatatttgcggttatctgccataggcggtgtcctcctttggtttccaacgcttggagtaataccggtggcagaggataatcacggctcggaaactctgcttgcaatcgtgggtgcacccccggcaaaggtcgttataggtaattcggtttcggtggttgaggaaaaagctccattcaatccgccgtttgttgctcatgcgtggcattggtacgctcctttctgccgtttccgtgggtatcacggatagggcgggaaaactgtatcttctcggtatcattttcggggattttttgccctgtacgccctgttttgaggtcggggagtattgcggataggggtaagggcatatccctgtttttgtttggtttcggtatcatttcggggcggtttttaacgctcctgttcatgctttttctgtctgctcggttcgccgtggtgcatttgggaaagattgcttttcatggtctgcaactcccggacacgctctttatttgcccggtactcgttgtaaagggcgttcttctcggcggtaagctgctcgatttcagcctgcaacgatttataggtgggcagcttgataatgtctttttgccgaaaatatcttacggctgcgtctgctatgataaagtcgctttcatgcttttcccggtaggctttgcgtgccttatcggttttctgctttttcaagccgtcacgcacatctcttgtcttggcataggcaagcacctgtttctgcaagtcctttttctcacggatagccgtttcaatgggcttcagcttggcggtgctgctgtgtaaatccgcattggcagacacaagggctgcgtccagttcatccggggtaaagccgtattgctccatagcggcaacggtagccgccatctgtttgagattgtggacagccgcccaacggtcatagccgataccttttccctcggctcgcttcgccgcacggtcaaccattctctgaatgttgcctgtcggggcgattttctgcgtttttcctcgctctgtgcggtttgtttcagcggtatggtattcgggtatgggtacggtcttttcggcggctctgtgggcgttctgctccaaaagagtaagaacagcagcacggtcaaaatcatctcccagttttcgggcggtaatgggtttcgttctgtccggggtaaggtaggacaaccgccctcggctctctttgacgatcacaccctgccgcagaagtaaagcggaaaactcgtcaaaggtagtagcttcgctcatggcgttccgtatggtctgccgcagcttcgccttgtcggtttcgaacttggtctgctttgcaggctgcccctcggctgcaagggtggcattttccttgtcaagtttggcttgtcctttcttctgcgcccaatactcacgctcggtaatgcggtttttactgccatggagcaggtcgatttgatagagattttcccggtggcacatctccatgacctcggctttgaagtattccatagcagcgtccgtgcagcgatgtttgcacccggcacgggtatctgccggtctgtccatgtagggcagcaagggtacttcctcaatacgcagagaattgataacgatatgaacatggatattgccgctgtggttgtgtccgtccgggtgggtgcagacaatggcttggtgtccggggaaatgctcggcacaaaatttctcgcccaatgcttgcgcccggtctacggtcaagccgttgtccgctgcgtcccgtgggtcaaaggaaatgatatagtggtggcttttcacatcttcccgtttttggtttttaccgtatcggagatttgcccgcatacaggcaacggcaaaatcttcctcgccgcagttcagcgtggctatccgataatcctcccggagtatgagccgcccggtttcgtcaagggtgggcttcatggtaaactcgtcatgctcaaaggttagatactgctcggctgcaccgtagtccgcatttttagagctgatatgcttgaatgttgccaacagcgtcacctacctttcgcaagacttcaaacttcaaggcggcaaggtcggaaatggcggctcgcacttcaacggacagcgtattgtagggcgttccgtattcgttgagggcacgggcgatctgattaaggttgccgccgatttttccgtattcggctatcaactttccaacagcggatagcagttcatcattgaccggggaaacggtaacaatagggcgaatggtcacccttgcaatggcttgtcggataaactcggcttggctcatgtcataattctttagccgttccgtgaagtcggcatattcttcttcggtcatgcgtgtcttgactacatggcttcggtggggcgtattgtatcgctttcctatgggtatcaactcctttcacttaccgccgttttgtgggcgattttttaagtattttttggtgggattttcaagcggcacaagccgcatagcagggtttggggaaggaactccccaacaagatttaccaaaggggcaaaaccgcagatatgcggattttggcaccgtggtagaatcttgctcttagtaagccgcagactgcctctgtccgggcttttccgtacatagagcgaacggggcggggctttcagcccgctgtgcgcggtctttttccctttcgccaaagatacatttgaaaggccgtcagctacccgctgaacggggatttttcaaattttcttttgccttagtaatccgggaaacaggattttggcaaccggcggggcagagaaattttcctttcactccctacaacaccgcgttttgaaatttgccaaacggggcaggcagctttttctggcttcacctacctactacgggtggctttgcgattttgccaaacggacaacaaaaaaagcagcaaatctttttcagacttactgctttcgctggccgccggtgacggctggtattcagtttagtaaaaggctatcaggcaaatgatgttgaaagtgattttgcggtgtcttaaagcagttccaacgctcttttatacagtgggtctaattcacacccgcaacttccacattcctcatcagcctgcttaattgctgatattaaagattctttatcagattttccgtctaaccattgttgcgcgggaatagctattaaatcccaaccggatgcaacaaatttttgcataatagtttttaattcttccatagtgcggctcctttcaagatagcaactgacaaatttgcggttactctgattttaccatatctacagtgcaatgtctatgcttatcggtcaaatctgaacttgaatagcgcggcaattagctgttgtttcacatattcctcaacctcggcgttgacctgcccgcgtactttggaaaagtagcggatatatccggcgtagtgggaaagaacggcgtttaccgcgtccgggtcgccctcatgcgctttgacgattgtttcataggggagaagtttactcatagtctttcccctccatgagccgccgcaaccgtttcaaagcaagctggatatgccgccccgctgtgctgcgtgtccgtccgatatgtacgccgatcactcgctgcggctggcgcaggaagtaatagcggaaaatttcttcctgtgtctgctccggcaaacgggcaagggcggcggcaagttccgcatgatacaaaacggcggtttggtcgcaggcggtaaaaagatattcttcaagctgctccggctcggcaagctggacaaacttctcattcatcagatagtcaagggaaacttcccgttcccacctccggcgcagattcaaaattttatctatggctgcgtgacgaatgacaatcttgcaaaaggcattaaaggtgtactggatatggactttataggcttcatcttcggtcatggaaattccccctctctgataatagtgcggggcggcagcactccttgctgtcgccccttgattgcctgccagcaaaggcgggcggggctgtcaacggcggcgcgtatgcgccgttcatcttgaccgttgactggctcggctggctttgctattccgttatctctttcagttattgtcaaaggaaatgtagatagttagactatcgggtatgtagctgatacttaaccactttttgtcgtttgataaaagtgtcccgatagaaacatagttttctccctcgatttcctctgacacattttcaattacggaaaagccttcttggttcaaaagctccatatactcgttatagtcgttttcgctaatgccggtaaggttgatattgcaattctcatgttctgtatcaagtgtagcccatgcaaccgtaccaggcgcaacaggaagcccctctgtgtactcattcgcaggccaaacaccctcgtccaattttgtaacactattagattgcgtattgttctcattgcttgtcggtgtagatgatgtattttgattagaacacgcagccaaaaaaatcataaccatgattgtgaatacagaaatatactttttcattagttacctcctgtttttgtgtatggttcggataattaacaaaacagcaatagctgttgctgcaaacccaatagccaaaaggatttgcgaaatatcaaaggcaaacgcgccctcaatctgtatatttgttgtcgcgtctgcttgtccgattgctccttctggtacttttcctgattgcgtaacagcatataccgaaaaggcggcaaccgcgataacaagcgcagcaagagtagaaatgataccgttcctttttttcgatttggtgttatcaatgccaaactgttctgcggtgctgtctgcaaattcttttggcgtccccaaacgctggataatctgctgctctgtttctccatgctccatagcagacgcaaaaacttcattcaagtcacgcacaacctcttttttcattttgcgtggtaaagatagttccttttcaacctgtttgatatattgttctttcatttggacaccctcgcttgttgataactttctataaagccgtttacgcagttttcatagcttgaccaaaataagattagttcatcaagtacattcctgcctttatccgttaaagaataatacttttttgagccgccatttgccgcagccggagccaatcggcatttgattagttctgcttcctgtaaacgatacagaatggggtaaatggttccctctttcgcatatcccaaaacagacgcactattgttcaattcggttataatttcatatccataagtttccttgcgtccgattaggcataagagtatcatttccagagagccttttttgaattgctggacatatttgctattcatatcgtcgcctctctttagtttcgctatttaggttcgctaagtagcaactatattatatctcttccgaggtatcagagtcaataggcttaacgaaaaagttacaaggtgtgtgcgtaaggtaataacggaatagtgggctgctgtctatcaaattcttgtgtgttactttatggcacatgagcattggcgccggggttgtcgttgccgtaaccttccagcaggttgataacgccccagataccgagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccgcccggtttccgggggcatgattccggctgtcctcctttttcattattttttctcgcgattgtccgctttgtacgccaatggcccatagagggcagatgcggcgaatagataagatcactcccttctaaagcggaacgaaattaagcgccctttgtgtctacttcatatacatcgcagacctcattgggcttgagtttcagccttgcggacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgccgccatccataacagcaagctcatcctggctcatcagctctttccccaatttttgatagttgagtgaatgggatgtttccctcccacggctctctccggtgttgtaggtgtcgatggtttccttacccagcacggcggccagctccttgagagtggtcggctccttaccgcccagaaagatggaagtatccatgtttccgataatggtatctgcgttatccttataaatcgccttgagctgactctgcgcctgcaacaccagacaggcggagatctcacggcttcggatggtggccaccagcttttccaacttgggtatctggccaatgttggcgcactcgtcgatcagacagcgcacatgaaccggcagtctgccgtcgtacacatcgtcggccttttcgcagagcaggttaaacagctgggtataacacatggatataaggaaattaaagctgtcatcagtgtcactcatgatgaggaacagggcagttttcctgtctcccagagtatccagctccagctcatcataagccgtgacctcacgcaactctgcaatgtcgaacacggcaaggcgagcgccgcaggaaatcaaaatcgacttggctgtttttcccgaaacgagttgtcaaggactttttaatcaaattcacaaaaaagccacaaaaaagccacaaaaaagtgccagaagcactttcatgctcctgacactcaggcgggtggggttacttttccccggcaaggattttttcgcaaacggtctggtattccggcagccgttcaaggaaggggttccagcgccgctttatctcggccagttccagagggtcggcggtctgttcagtgtgatcgttgccggtcatctgcaacacatccatcgacacctcggaaaacagcacttcggcaagctggtcggcggtgtcaacgagtatttcttcctcgacataccgcttttttgtgctgattttcagcagcagatagcccagcttatcagaccagagccattccagataggggctttcccggatgtagtcggcaaacaccgcgtaaaccctctcaatctctttcttttccgtttcttcgtacagcattttcatgtcctccttggctaaaagttttggcgtgtaccatcatcagtttaacacaaggcggctggctttatcagccggtcacatctgctgtatctcgtttttgagcatacgcttgattttgtcgctcatggtttcagtgctggtctggctgaaatggacgcgcaccttgtaggtggtcttgccgattttctttaccagcgcgggggcggcgctctggtagtggtggtgtctgcggtctgcatggtacgggtttcttcgctcatggcgctcctttctccgggcggggctgtgccgtccggcacaaaattactcatgcttacggtttacaatgtctttcgccgcctgcttggtggccccggcgttttcctcccggaagtttttcccggcaaagaggatcggggcgcaccgttccaggatacggtcatagatacgagcgtgggccaggtcaggcgggtttttgagttcggccagcttcaggttggtggtgatgatcatgggcctgcggctgcggtagcggctgtcaatgacgaaaaacatctgctccatcgcatactcggtactgcgctccacacccaaatcgtcaatgataagcaggtcgtactcgtcaaagctggcgataaagtcggccctgtcctcggaaaacattcccgtcagacggttcaggatggtgggaaagttcgtcatcagcaccggcacatcccggtcaagcagggcgttggcgatacaaccggcgaaaaaggacttgccagttcccacatccccaaacagaagcaggccggtgttgttcctgtatgcctccttccagttctccacgtaggcgcgggccttgtccatcagaggattttggccgttgtcgttggcaaaggtgtagtcgtacagatagcggtcttgcaggccctgggccttccggcgcttgatgcgctccatgcggcgctgccgttcctcggcggccttgcgctgttcctcggcctcccgctgacactggcagatacagcggggcatgaagtagccgggtttcccaaagcatggcacaacggtctgcctctggccgccgcactttttacagtgaatgaggccgtctgccgggtctatgtactcgtccccggccagttccataccggcggctgccttgtcgatcagcgcccggatttctgcggtaatctccatcatacggtttcatcctcctttacgctgtaatcacggttgcgggtgggcggggccgcctttttcgcgtcctcaccggcccagcgccggatggtggcggcatggctctgataccgcttaccggtagaggccatgtattcggacagcttttcgatgtactggccccatacagtgggaaaactggcctgcaagtctgccagttcctcgtccgtcaggaaaacattctggtaacggccataggcgcgggcgctctcactctctctattctctatactcttatctctaatatctaatctcttatctctaatctctggtggacaaatgtccccctggctatatggtggacaaatgtccgccccgccggatgggagcagtttttgacgcttcaatcgcatacgctctttctttttccgttccccctcggtagaggattggccgatcagcagttagatgtcggccatgtagtaggccccatcggtcaaaatctccacaaggccaaattcaaggaataccttcaaggcccgttccaccgtccccacctgatggcgggtaaaggtggcgatggtctggggcgtgtggggcagatggtcattgagcatgaggataccgccgcttttgagtgacatgaggtacattttcagcagcagattggagtacagcaggccatcctgcatactctccaaaataaccatcgtttcgctgttgtagaagttttctttcagcttgaggtagtaatattttcgattgtctgacataggcttcctccttgggggttatttcaggggtctgtatgcctttagagggccgttttgggggccagaggataaatctatcaggcccccagcgacaccctcgaaaaaagccttgatttacaaggggttttcagcccctaaagcgtgacatttcgccctttgtttccgcttgcgctgggcggccttgatacgcttcatgcgtccggcacattccgggcagtatttggcccggttggagccgggggtgaacagcgccccgcagacggcgcaccgtttggcgtccaggcggtggaacagggccgtttccagttctctgtccagcggcagcaccgccgcccggaaccaccggcacaacagggagtaggaaatggactggacgcagacacattcctccccatcatccagcgcgatacagtggccgccgtcatagttgcagcactcatgtaccagccgccgcgctctgcggtactggcggtagtccatgacggggacgggttcaggcttgctttttttcatgctggcacttcccacacccgccgcagttgccgcagccctggcaggcatgggcctccggctccgggccggtgggcgcgtctgccgattccggctgcaagagggcaaggggcaggcggatattcaggtggatagtgacgggcaaaataatttgcttcatacagtgacctccttcaatgaatttactgttaaatattcgtgcaaagtattgttttcttcgtgcaaatggcatatactaaaagtaccagcagaaaggggttgatgatatggctggaaataccacaaacatcagcatccgcatggacgcggatttgaaggcacaggccgacgccctgtttgcggaactcggcatgaatttatccacggcgttcaacatcttcgtgcgccagtcgcttcgtgagggcggcattccctttgaggtgaagctggaacagcccaacaaggaaacgattgctgccatgctggaagcggaaaggattgcaaaagacccgtctgtaaagggatacaatgaccttgacgagttgtttgccgacctgaaaaaatgaggaaaacaaagtacaccgtcaagtacacgaccgctttcaaaaaggactacaagcgggcaatcaagcgcggcctgaaaatcgaattgctggaacaggtcgtggcgctgctgtcgatgggcgaaccgctgccggataaaaaccgcgatcacgatttgtccggcgattgggtgggccatcgggaatgtcacattctcccggactggctgctcatttaccgtatcgaggatgatgtgctggtgctgacgcttgcccgcaccgggtcgcacagcgacttgttcggcaaataaaccatctgccgccgtatggggaaacctgtacggcggtttttctgtgtgcaaaagggtgtcgtgaaacgcgacgcacctgaaaggggtcggcaaagcgccgtaccctttaccgctccggcccccggtcgcggggcttgtcccgttcctgccgggccagttggtcggcggccttgcggagccgttccacagcttttagctcctcccgcatagctttcatgtcgatgctgtccacctgtttctgggcggtcaacaggtcgatctcacgccgccattccttcggggtgatttcctcgccgctggctttcagttctttcagataccgggccgccgcgtcatagaggatcagttcccggctgtggcgctgctcgaacagttcccgcttctccggctttaccctggcaagctgcttgtggacagtcttatactcgttgtactgcgcccacatctccccgcgctcggtgaggacagcgatccggcgctcagccttgacgatctctcgccgcaggtcatagtaacgggtgttcatatctgcgattttttcatggagctgctgcatggattggatgccgtttgcctgcaaaaagctgaacagggcggcgctctcctgtaaagcccggattttgccggtgcgggtgtcgggccgcttgagctgctgctgggcctcccacaagtcaatcatgctgggctgctggccctccggcttctcggcctcggccttcgaccagttgtagaggcgggtaatgcgggccttgatttctttcagcagcttgttgtcggcggcgatctgccggttgacttcccccttgtcggtgcggatgccgcgcttctccatctggctggccgctggccccaggtggacagaggggattttatcaatgccctgtcgcttgtagctgcggtggtctaccagggcaggctgaccggctgcctccaatgcccggttggtataagccgcccatgctgctcgccaaatctccacattccctttgtcgttccagtcggtggtgtcctcccggtggttcttccagccgcctctctcgtccgggatgcgctggccgttttcgtccaggtcgtatgccttgcggcacttcgcgccccatgcgccgttttcttttaagggccggacggtcagcatgatatggacatgggggttgccggttcccttgtcatggatggcaaaatcagcgcacatccccttgtccacaaagttgtccttcacataggcccggacaagggcaagctgctgttccctggacagttcgcggggcaaagccgcctcgatctcgcgggcaagctggctgtccctggctttctcgatctgctccacactgttccaaagggtggagcggtctgcaaattccggcggggcgtgggcgggcagcatgatctccgcatggacaacgccgcccttgcgggtgtaatcgtgggtaaggccgtcccattcattcgtcagctttgttccgctgcggtaggcggctgcggcaacagcggaacggccctcgctgcgcttgatgatactaacgggaatatgacaaaaatctatgggtggcacctcctttcggtaaggggtattcaggctccgtggagccggacagacgcgaagcgggtgtctggctgcgcggggcgcacaaggggtttggggagtgtagcgccccatcgcgctcggagagcgcaacagcccccggcagggcgcacgacaccggcaacggtgtataagtgcgcccttgtaaacaagggacttacggcttgtccccggatttcggcagttttgcggccagttctgccgcccccggaagatgggacagggcaatcaggaacgctttgacctctacgccgggaaggtcgggggccagagggaaaatgccctccaaaacggccccacgctcaatcaggcggcgggtgcgggccttgcgttcctcgttgagctgcttgttctccaaaatcttctggcggttctcaagctgctggatctccttcaggacttcttcgcgctcgtcttttttcggtttcgcttgggcggtgtggtctttgtgcatatcgctttctcctttggcggctgcatccagccgtgtttgatataatatttctgcaacttaatgatggcgttgcgtaccgtgacaatggccgccgatgtggtaaagccctcagcctcggcaatctccttaaagggcttttccgcccaaaaccgggcatgaaggcagctcgcctgccggggcgtcagggtggcaagggcctcccggagccgttccatcatcagagcgcgggcggcctcctgttcccgttccgtttctttctccatcagaatatcttccggggaaacggtctgctccgggaaatggttttccatgccgggggatgcgtccagagagtaacagtgatagtgctgcttggcgtcattggcgtcctctgcgcggctttcctctacaatggcatctgccacctcgtccggtacttccacaaaggtgtccttcttgcaaatcgggtagtagtattttttcaggttgatggttttcataggccgcttgtccatttccggcgctcaaagtaccggcgcaaccgccggagcgccgcatggatggacttccccgcctgggatggagtgataccctccatcgcggcaatgtccttcactttcatccccagcatataccgggcatggacgcggcgggcctgcgttgggggcagagaggaaatcgcctcatagagccgccggagcagttcagcatattcggcctgcgcctccttttccatcaggcaatcctccggcgaaggctgcgcccagccgatggcggcgttctcaatcccatcatcgcagtcaagggagtaaaacgccttatagcggtacatcttgcgctccctggcggcctcggcccgcttgtccagcagaaacgcttcaacgatttcatccgacacctctatgaaggtgtcctcggtgcagaacgggtaatattgcttgaggttgatggtctgcataggcccgccctcactctgacgggaaaaggccgtcatagcagcgacgcatattccgcaggccccgccggatggcaacgctgaccttgctgctgtctacgccctccctccgggagatttccggctggttgataccggcgatgtagtaggcccggacgcggcgggcctgtgtgggggtggcatgggccagggcctccggcaaggcggcaaccagccgcaggcgggcggcccgttcctcacgctccaccagaatatcctccggcgatctgccgtgttccagcgcgtagttctccgtccagctatatgcgtccagggagtaccaggcgcggtggtagaccttccggcgctcatagttgttcatctcgcgctgggcctgccgcatggcctcccagacctcgtcgctgacctctacaaactcgtcgtgccggtagtggggataaatccaccgcagattgattgttttcataggcttacctcctgaaaatgggagaggcggacagctcgtccgctgtccgcccctcgctgagataagggaaatgatccctttcacttggtagccagaaaacaggtcattcgttaagcctgttctcaaagaaatttataaatttttttctgaccgcctccacactttgataaacagccactttggagcagccgcacagcacaccgatctctgcaaggctcagcccgtcaagcgcatagagcaggaaccggcggcgctgggcctcggtacaggtgtccagaacagccatcagctcatgcagcgtttccatgcggcaaaggtattcctccggcgtttcgccgtagacccctacaccctcggtggtaatgatgtactcgtcaaactcccggccatcccaatgccgccgctgttcatggaacaggttctccgttttatgatcggcccggtcaagaaattcatagacttccagcgtaacctccacggccacagcttgtccgttataattgatggtaacttccatctgcctttcctccattcagattttttgggtaaatctgaatggggcggcggagaacggcactggggccagggttcgggccatgctggcccgatgttccggccccacaggtatgaaaaaacgcccggacagcagaaagctattcgagcgcaaaaactccaatattcacttacagaatgacaattttcgcaccggctaccagacggggcctgttcgttgactgggctttttttgacggtagtgaaatatcgtctgaatttgtcggcggtcaatgtgcttcatggcggttccctcctaaagccgccgtgtcagcgtgtagtcgtcactcctttgtcgagggcataaggaacggcggccttgatgttactcaaaaccgccgcagtacccggaaaatccattttgggcgcacaaagctgcctgccctgcaacggtttttttctttccccgtcttgcggggcaggatcgcttggcttattcggtttattcttgctcctgttcggctgcctctttcagccggtcaaaactctcatcgctgatgatgtgttcaatacggcaggcgtcggcctccacagtcttggggtcaacgcctgcggcgataagctgctcggtaaagaagcagtggcgttcatagattttttcagccacctcgcggcccacatcggtcagttggagaaagtgatcctcgtccatcgtgagaaaaccgccgtcccgcaaggtagccactgcatggcacacgctgggctttgacacctccatgtgccgggccacatctacggagcgcaccataccgagtttcttttggagaacaaggatggtttccaggtagtcctccccggacgcatgaagcgttttgctaagacgcattgattatatttgctcctttttcatgtgagaaaaatgcccgtaagagtttgattgcttcatcatccattggccgatgccatagcaccttattctcttgaataaacagaagataagtacaacacttataaatcaattcaggatcatgggtaatcaggaataggctttttcccatgtcttttaagcggttcaaattatcagacacctctaccatatggaaatagtctaagccactggtcggttcgtcaaaaacaaggatttccttgtttgaggcgatagcacttccaatcgctacccgttgcttttccccgccagataaagacatgggatgcagtttgattttggctgctaaatcaaggctggataaaatctggtttgcccattctgtattttctttttcgtcctcaccgtccatactaagaagcaattcatccaacacatcctcggtaaacagttggtggtttacatcttgcataaccatgtaagatatgtggcaccgctgctttgcacgataagaatgtccattaagttctaactcacccaaagcccgtttgtccaatccacacaggcaacgagcaaatgtggattttcccgcgccgttattcccaataattccaatgatttctccttgtggtagcgtcaaatcaggaatgtccacaataagagggccgtgtttatcataagaaaaccgaaattccttgatatgtaaagtcggcggtttcgcttttggtttggcctccggtggaaggttgaatggatcaagggcgcgtagccccattccctgtaaagtttcgggagacagtaattgaaattgctgccttgtaaattccttactgatctctccatgtttcatgtagataatgcgatcagctaaaggaacaagataatagagccgatgttccgctaccaaaatagttttttgctcggattgccaatggcgaatgacttgaattaaatcttcaattgttgcaatgtccaaatttgaggaaggctcatccaacacaaaaatatctggatggatcgcatccgccgaggcacaggcaattttttgtttttcgccacctgacaatgcaaacaggcttcggtttaacagcttttccagtttcaaactctttgtagtatcttcaaggcgccttgtcatttcaggaaccggcaatcccatattctcgcacccgaacacaatctcgctggttgtatctacgttgtaaaactgtgttcgcggattctgaaacaccgaacccaccctctgtccgatttggtacagagggtagtcttttaattccttaccgtccagcaacactttcccatccaatttgcccgtgtaataatgcggaatcagaccgttaatcaagcgggtcaaggttgttttgccgcatcccgattccccacagaataaaattgtttctccgtcatggattgtgagatcaatgtgttttaggctattctccgtttctccactctcataagtgaaagaaacatcctttaactctatcattcttgcacccccttaccacggactaaaaaagtatgtaattatcagcgcggttccggcaatcagcaccgttatcaagtcccagccggtaaaaccgactttggtaatgttggttcggcggacaggattatccaatccgcgtgtcagggcagccgcagagaggtcgtccccaatcttgactaccgaaatcatcaaagggataaaacggtattcaatgagagcggctggattctgccaaaactttttcgttccaaattgcacctcacgcatccgcatggcatcctttatagcggcggattcttcctgcatagtgggaatgaaacggaacaggacagagagcggtattgtgatctgccgtccaatgtgcattcggcccagcgcagtaatgcactcgctggccgtagtagacttgatgatatatgcgcccataacaaaggcaggaaataatcgcagcactaaacccaccagcagaaccaccagcatgttgataaccataggaaattgaatggagttttgaactgcttgcacaaacagtcctgctgtaaataagcagaaaaagacaatggccgttttatattgcctgttcgttaaaagcaacacaaatgggattaaggctaccgcaatcataaacgcggtgtggctatatagaaattccgcagtagcaacaacagccatcagcagcaactttgtccgggggtctaaacgaaagccacttcgtgtttctacaacggcctgcaactgttccattacacaatgcccgctctttcaaaatgttttttcagcatcttatgtcccagaagtgcgcccagaataccccctacaaacagcagcacaaagcccacatacagcatccacgatggcatcagggattgcagcgtattagcgtattgatctcccatagaagtatgaatgttttcccaataggcttctcccgcaaaccaaaggttggcagggcaccccataatgccgaggcagaagcaagcataactcaaaacagttaccttgaacttttgatagccaccaattttaagcactacatcacccaaaaggccgccgagaaaccagccgagcagaccaatccacccataaccaatgaggtagaagaaaataccaccaataatgccggtaatggtaagcattccaaatttcctgatttttgtgtaatacagcatcataggaataccgcaaacaatcggccagatcaggaacaaaaacgggtacactactggtaatgcggtcagcaatccgacaacaaagaaaataacaagggtcatggcagaataaatgccgacgttaataaggtctttacctgtgagcttattcgtattttccattttcaaaaagtcctttccacataatttatctgatactcgtaagaaacaaaagctattttatacagaagttgtttatgcaggccacctcctattcaatcggttaggttgtgctaaccaccagttaaaaattttggggatcaaatccccaaaacagtttgccacccggaactgaaaaaagcggccaatgtatgagcatattttatcgcggcatctttcggataattgtgcaagacaatttctgcgatagatgaatagtaagaatgaacaagcatatgccactcgtcatcctccaaatcatgtacgggaactccgcgttccttcagttccgcaattagcttttgtgtctcccgaacatcggaacgcaccacatcatccagaaaagaagcatattttgtccccgcagactgcatcagcagcagtttgaatacatcaaaatgttcataaatgtattcgataatctggcggatcgtgtcctccgacagtttccagagttgctttaattcatccgtccgagctaattcaaaatgcttgatgacagaatcggaatacatctcagataccgcctgaaccactggttcgacaagtgcgccgaacaaagcctctttgtcctcgaaatgattgtaaaatgccccgtttgtcacatgggcggccttacagatttcacggatactggcacgttcaaaaccattttccagaaaatgcttttttgcacaggccaaaagattttcatgggtctgctgaaaatcccttgacatttccatccctccatcctatacttgaattacactgtaatattacaccgtaattcagattatatcacgatgccatcgaaaatgcaatactctccttgtattttcagttgctccttgtattttcagttgctcgaaaggaggctttcttatgccaaataaagaaccgggtgcaatccgccaactctttgcttttgtgggcgagagaaacagcaaaatgcgtatttccattcttcttgctgtgttaggggaaatgtttggtatcgtaccattcctaatggtggcgctgttggcggatgaactctaccgcggtacagccaccatacagcgtgttttgttctttagtggaatagccgccatatgtcagcttataaaaatgcttctcacatggcgatcttctcttatgtcccacaaaatttccttcacaattttgaaaaatatccgtgaagcaattacagatcggatggcaaaagtcccaatgggcgttatgctggaaacgcctacgggaactttcaaaaacctaattgtagataatgttgcaaagttagaggattctatggctcattttatgccagagctgccatcgaatattgcagcgccgttgtgcagtattctcctgattttcattctggactggcgcatggggcttgcatccctaatcacaattccactgggtattctctttttcgctgctatgatgcgcggttatggccctcgaatggaaaactatatgcgctctgccaatgatatgaacagctccttagtagaatatgtcagcggcattcaagtcattaaagcgtttaaccgttctgcatcctcttatggaaaatactcaaagtctgtcaactattttcacgattctacaatggagtggtggagtcaatgctggttttggaatgcagcggcacgagccgtcctgccttctactcttttgggtacattgccagtaggcgcatggctttacatggaaggaacgctttcacttcccgtatttttaatatctttagtagttccgctggggttcgttgctccattgatgaaagtgtccgaggcgatggagcaagtcagcatgataaaaggtaatttggagcaagtaaccgctttcctaaaaaccccggaacttgtccgaccctctgaacctgtatctttgggagaacgtacttaccaatttgaggacgtacatttcggctataaagaaaccgaagttctccacggtatttcttttcaaaccagacccggcactatgacggctattgttgggccttccggttctggtaaatccacgattgcaaaactgatggctggtttttgggatgtgacttctggctctgtgcgtttcggcggccaggatattcgtcaaatcccttttgagcagttgatgggtgaaatcagttatgtggcacaagacaatttcctattcgacaaatccattcgggaaaatatccgcatgggtaatccggcagcaacagatgaagaagtagaagatgccgcaaaagctgctaactgtcatgactttattatgcagttagagcagggatatgacacactggccggtgatgccggagaccgactttctggcggggagcgccaacgtattacgattgcgagggccatgctaaaaccgtcatccgtagtcattttagacgaggccactgcctatgctgatccagaaaatgaggcgctaattcaacaggcaatcagcaaattagtggccggaaagacattgattgttgtagcgcaccgtttgaatacgattcgcaatgccgatcaaattctggttgtggcaaacggaaatattgcaggccgtgggacacaagaagaacttctccgggaatgccccatctatcaaaagatgtggcaagattatgccggaaccatagaagaagcagacttgaaaggaggagtggaaaaccatgcttgaaatgatacgccggatttttaagattgcgggtagaagccgacagaaaatcatcgttggcatcacatttaatattctcaaatcctttttcaatggttttatgatgttcggtgttttttggattttattacatttagaaaatcttacacctactattattctacaagcctttggtgttgtattaggaagtgttatcggacgctttttcttccaatggatgtatgaccgtaccatgagtggaacgggatatgatattttccgtgattatcgtctggaaataggagaaaaattgaaacaggctcctatgggctacttttcagagcaaaatttaggaactattcagacaatacttactacgacgattgctgatttagagggttactccatgcttgcaatcgagcagatgacaagcggtgttgctatggcagctctcatgtcaattatgatgttctttttcaaccctatcattgccattttaagtttgattggactattattaggtttacttgttcttcgttgggtccgcagtagagccgcgcaatatgctcctatttatcaagaagcacaggaaaacctggtgagcaaaacaatggaatatatccgagggatttctgttctacggtctttctccaaaggtgaggaaggacaacgagaagtacgcagcgcatttcaaaaaaagtgggatgcagattatgggcaggaaaaggctacggccggggttctccgtttttatattctggtctataagctcatgagctgtgtactgattgctgcggcgggtttgctttttatggctggaaaaataagtttgccctactgcttgactttcctgttttgcgcatttactgtgtactctgacttagaaacaatgggaaacagcgcctttttgagcaagaaaatcaacacagaactggatcggttagaagaagtcaccaatatacctcaaatggacaccagcacagacaaattagaaacttcccactacgatataacactggatcatgtatcatttggctatgacaagcggcaggtcatccatgacatctctctgaacattccagaacatactacctgtgctattgttggcccatctggaagtggaaaaacaactttgtgtaatttaattgcccggttttgggatgtgcaggatggcgctgtacgaattggcggaaaggatgtaaaaaactatactgcggatagtattttggagcatatcagcatggtctttcagaatgtatatcttttccacgattctattgaaaacaacatcaaatttggaaagcctgatgctacccacgaggaagtagaagctgccgcaaaacgtgcttgctgccatgattttatttcagcgttgccagatgggtacaatacaatcatcggcgagggaggctctacactttccggcggagagaagcaacgaatttctattgccagagcgattcttaaagatgcacctattattattttggatgaggccacttccagcgttgatccggaaaatgagcaggcacttttatctgcgatttcagaactgacgaaaaataaaaccttaatttcgattgcccatcgtttgagtacagtggaaaacgcagatcaaatcattgtaatagatcagggtagaattgctcaacagggaactcaccagtctttgatttcacaagagggaatttatagaaatttcctaaacctcaaactcgcatccgctggatggcagctttaattacatagcatgatataaaggccgggatttatcgccctgtggcggcaaattccggcctcttttatactatacttatccgtagatcaattcctgaaaaacgatttcctccgcctgcgctttcagcgtgttcatcagccccacccagcgcatggggtcacgggctttcagttcctcggtgacgcccgccgcctccatcatccggggcagcatggcgtccatccgctcccgcgccgcccggtcaatctccaacaggtgcgggtacagcttttcgctcaaaatcaagctgctgtaaaggccgggccggtgttccttcaggtagcgttgccgcatacggccatacttgccgatgggggcctccggctgctcggacaactccaggtcggggatgtagtaatccccgcagcgggtgtaagtcaattcgttcatgtttgtcctcctttgcactgtgatggttaaactgcggcgctggccggtaaggtggccttgcgcggctcctgcctgggtaactggctgacggtggtaaaaatgcccttctccatatcctcggcccggatcgcggcctttgctgcctccattttcgccttgcgcttggcgttgtagcgttcttcccattccttctgcttgccattagccttgcggcgcaagtagttctggtgaagcctgtccttgcgttcctccttcttccgcagttcttcctgttcctccggggtcaggggaaccggctgcaaggcaggagggatatagcggcccacaaagttgaagtagatttcaacctcctgtgtggtatcctggctgcctttgcgggcgcgttcatggacaaggattttctctacaaactcgttgagcatggtgtttgtcagcgtgtcgaagttctcgtacttgtcaatcagggcaataaacttctccgcagatttccggctctgctcatagccggtaacggccttttccaattccacgatttccgcattgagggcgtcctgctctttggcgtactgtgcgtccagggcctcataccgggcgtccggcagcttacccagggcgttgtcctcatagattttgcaaatcagcttttccagttccccggcccgcttttgggcggcggccagccgtttccgcttcttggatatgtcggcggtctgctgggctacctgcgtttcctggacggtgcggataaactcggcccggtcattcctggaatactccgcgatggcccggagcatatcggcaatcagggtcagaacagcttcggccttgatacggtgctgtgtagggcaaagggagccgataggatacttcccatactggccgcaagtgtactgcgggacgcgcttgccgttgtatgtgcggtgaacatacatcttgccgccgcaatcggcgcagtacatcaggccggtcaggggatgggcctccccaaagccgtccgggtagcgtctggcgtttccccggatacgctgcacattgtcaaaggtttcctggtcgataatggcctcatgggtgttctcaaaaatcgtccattcgctttcgtcaacatagtgacttttcttgtccttaaagtgcttgcgggttttgaaattgaccgtatggcctaaatactcctgttttttcaggatttcaacaacggtagaggcactccaacgataaatatccgcaaaggccttattcttgttcactccctcgccatagcgggcaaggtgaacggctggcatttcaattttttcttctgacaacttggttgcgatctgataggggccgtagccctccatcgcaagcgcgaaaatatggcgtaccacagcggcggcttcttcatccacaagccagtgttcccgcttttcgtcccacagatagccgtagataacggtgccggtcaggtgcttgccgctcatgcctttggacttaaacacagagcggattttccggctggtgtcgcgggcgtaaaactcgttcataatgttgcggaacggggtaaaatcatcatcgcctttcagactgtccacaccgtcattgatggcgatcagccggacaccgcgctgccgcaaaatctccatgacctgaccgactttcagatagtcgcgtcccaggcggctcatgtcctttatgacgatggcctccacccgtccggcctcgacttcctccatcatcgccagaaagccgggacggtcaaagcgggttcccgatacgccgtcatcggtgaagtgggtagggttcggcagtccattccggcgggcaaactcctctaacatctgcttttgatggcttatggagttgctctcgccctgtaactcatcatcgcggctcaaacgctcatacagtggggtgattttctcgtttctcatggctgtacctcctgaaatgaaaatgctctaagtgactgcttcactaaccatgacaaaaaccatgattaagaagtcacttagagcatacatctccggcggccagcttatatttcttatactggcgcaccgcaaagtggtttggcttctcggcttccagtgcatcaaacatcaggtctacggggtttttgaactcctcgtcatcctcacggacttccatggcgttgatgaactcaatgagggtggagaagttttgttcctccaccggagcctcataatggatatagccaataagcgcgcagtacaacaaggtttctgcttttacccagaaatcgtctccggccttgccttcgcctttggtattggcgatcagcgttgttaccagcttcaagatgtccttttcgctatggatataggcgaaagggttatagtgcatggacttcttgaagttaatggtatttaggaccttgattcggtacggctcataaatgaccttgccgtgcttatccttcataggctttccgtctttccccagcttgggtgcgcccctttggagcatttttccgcactccaccaaaatggttcccttcgggtctgtgaccacataggaactgtgcatctgcatcagattcggtttgagccagaagcgggtcttaccggaaccggagccgccaatcaccagcacatttttgtttctggcggtctttgggtccttggggcggctgttcattgtcaggctctccgttttcgtcagaatcacattgttctggaataccgggtcgatgtagggtgtaatgtcctcatgggttccccaccgggcggaaccgtattccatgccgtgcctgtacttcttggcgttcttgcttttcaggtacacagccagccgcaggccgccgcagcagcacaggcccaccaacaggtccagcgggtgcaggctgggccaccagctggccagcgccaccggcagcgtggagaagaacgagagcatttttgccgaagcgtccgcacccacggccatccgccacgcttcaccgaagttggtggagaaaagccccatcaggatatacggcagattcagcaaaatgagctttttgatgttcagctgctttttcatcgttccagctccttccgcttgttccggtccacgacggcgtgttttaccagttctttgaactggctcagctttgccagcacggacgggcgctcggatttcttcgcctttctgacctttttcccggtgtactcggtaaaagcagcggtcagggcatccgcgtcccgacccttgaaaaagatcaggtacttgggtggggagctgctgcggtccttcttcaccgcatagtccacgccgtatttccgggcgatcttctcaaactccttgatggaggggtcggtgatctcgatgttggaaaccccttggttttgaccaatcagctgtttcaccgtctgcttgccctggggcttcacaggcgcgtcacggcttctctgcttttgcagcttcttttccttgcggtgggcaaggtacttgctgatggcggctttgagcagcctgccggtgaactttgttccgctgacaaccagcgttaaagtcctgttttccacttcttcctgcattttcatcgcctcctttccacaaaatgtgcaggggtggtgcatttatttctaaggcgggaccaccagccgccggagaaggtatttcttcatcgaaccgccctcaacgaatttgctcagaacggtcatagagcaaatctccatttctgacctttgcatgactgagaatcttgatctgtccctttgcctgactgttcagagctttttcatagcccttatctgacaaaaacaggcgggttcgttcacctttccagcccaccggggagtcatgcgtcagcacatcaaaaataatcatgtgccgggtgttctcagcaaatcgctggagatccatgtagtcatggccgtgatagttctgcgctccagctttctggcgcatttcttccatcagctgaccgattgttttgccttctggcataaaactcacttcctttcccactctcatacaaccatcaaaatcatgtctctcagctgagcaaagtagagtttgccttgcggggttatcagcgtataggagccgatatgcccgtgattgcagtagtctttgacacaaaacagtccttcattggctggctttgcatagggcagtacattaccggatgcggtgcggtacacaaaacgcttttccagaaggaaacggacaaaccgacgctccgggacaagcaactctttggcggtggtgcggaggttggtactgtgattgaggtcgatgaacaaatcataaaaggctgccttactctccagcagggcattttcctctcgtagcgacgcattttcttcccgctcagcaagcagctcggagcagagctttatcagagcttccggagaagtggctatctcccacaacttctcttttgtgagataggctccgtgcttgcgaatggcaggtagaacttcatcaaacacccattgttcaaaccgttccgctgacggcagtttactatgggcgatcagacgatatagatcaccttcggggataaagagcatttcgaccatttgtaccgcggggcttccatctgcctttttcccagtctggacccctatggaacatttcgttccacccctggtatggtcgcggacggctttgcgtggattggtatatcccagcgctgttgccacatctgtaccgcaaaataatactttgccattctgttccaaagtgcgaatgcttccgaactctggactattgaaaatttcaatctgattcatgctgtgcctcctttggtgtaatacaaaagcggctgattaccagccgcctgcgtgcatatcgtgatttaccagtgaagtgtagtggttattcatggtggtaggagcgttgaacagcactgcaagcaggtactgcttgatgttgtgtacctgggtggtgttcttttgcagacagtccatgacaaactcgatgtgagagctgtccagcttcaaaaagcgggagcgtacaatttcatgaggaaagtccgcaccagagatccgggtggtctttcgtttggcacagaccgtttctaccaacagctctacgatctcattcaggtcatccaggtagagaggataacgctgcttcagacaatcatactcgatattctccaaaatcaattcccgataattttctatctctgtgacagacatcgcatcccttcctttccgttccggcggtattaccgccgctgtttcccggaagggaatggaatcggtatttgatccatgagtattttgtttttgggtatttgatttcttagtatttaattgtgttggattttccggtaacggatttaccgctgacgggtttaccgttatcgggttttccgacaacggcttatccaacattggttctccctcgatgggacgctcaaaaatggtatactcattggctgcgaatttaccagaagcatcagttgtctgtctgcgccgaatgtatccggctgtttcaagctcattgacagcagagcggattgcatctttgctttctcgattgatatagctgagtcctgacagcgtataatcccagtcatcaggcagagataacatttgcgacaagagaccctttgccttcaaagaaagtcgtttgtcttttagatgaaaattgctcataaccgtgtaatcgccagtgcgttctacacgaaaaacagccatttacttcactcctttcatttctcaggtatgaaaaaagccgcaattcataaaagaattgtggcagcggttagggtctgtctgtatcttttttcttgcgtcggtaggggcgttttggcattggtggtttatcaaacagatccctttcctgagaaaatggtaaggtttgaaaaacacggtcaatctcggtggattccatatcacgctgtgagcggcaatcttcttgaatagcttctcggatttctcttacagtacacatattcattcctttcctttcgttgtatcggttatgaacgacggtgttttttaggcttgaagtcgaggatatgcccctcaataacatgggcatatctcttaattttgatttctcgacgctgctggctttgcagagctgactgatacccgtcctctgtgagaaaaagcctcatttcgtcaccaggttctccataagcagtagggcgcaagacagtaaactcaatcatccagcaagtgctgtcccaaaatcgctccactgcaagaatgttgtggcctttcagctcccttgctgcaatatctttcataggctctcccttcatcgttcctgatctcgttggcgttttttctgccattgttccagcagtttaataatggtttcctgcattttggccggtgtatagcttttggggaaatactttcgcaaggtatcgctgctcaaggtcactttatccagatcagcctttttttcctctgacatgatggcaagcatcacatcttctgacaatttcccttcctggctgaactttttcattcgctgagcctgagagagagaaggggtagcctgctcatagtccattgtttccaccagcatttgctgttcgtccgttttcaaaaaagagagttcataggctgggttaaatgcgattttcttttcatccaccatatccaaaagctctggaatcagttcagtcaaacgaacatatcgcattacctggataccgcttcgttcaccggcttcttttgccacctggtctctggcgctcaacttctgttcaacttgaacagaagtcaggtctgttcttgctccttgatgtttaatggcttccagcttcattttgtaggcaaaggccctttcactggggagcagattttctcgctgcaaattgctgtcaaccataataattgtggcagcatcgtcatccaagtcgcgcacaatgacaggcatggtttcttttccggccaattcgctggctctgcggcgtctgtggccggctaccagctcataaccgccatcaggcagtggtctggcaatcgcaggaaccaaaactccatactttttgatgctgtctgcggtttctatcattgcatcatcatccttgaccttgaaggggtgatccttgaacggatgcagttcagataggggaatttcctgaattttttccagttgctcgtcttgccgactttcttcagtagaaaacaggtcatctactgaggccagctctatttttttcgcgctgcttttcaagtttcaatacctccttcgtcagatttttgtagccctcagccactttgccattaggatcatgggcataaatgctttttccttcagcactgatttctttagccctgacagaatgaggaatttctgatgtaaacaccttgatcttactgccataggtttcgcgcagaagagcggagatttctttggcaaagttggttcggctgtctaccatcgtcagcagaatcccatcaatttgcagcttgggattgatttgtctgcgaaccttattgatagtttgcaaaagctgctccaaacctttagctggaagatactctgcctggacggggattataaccctattagcggcagccagtgcattgaccgtaagcatacccagggagggctggcaatcaataaggatatgggagtattgccccttcagcgtatccagatattgtcgcagaatggtttctcggctcatagcgtttaccagagatacctccataccagatagctggatgtccgcaggcatcaggtctacgccctcagggtggtgcaggataccctcgccgggacgaattggttcatccatcaaaatacggcccatagcgtctgacagtgtaaagggcagcttatcaggctgaggattgcccaagctgatggtcaggcttccctgtgggtctccgtcaatcagaaggactttcttcccggactgcgccagaccaattccaagattggcacaagtggttgttttgccgacaccacctttttggttggctatggcaataatctgtgtattcataatttcacctcatttctttctaagtttagatatgaaaaaaagtgcctgctctacctttcctgaaaaagataaaacaggcacttttactggctctatacctcttgtaatgaacctctatgtatggtaaactatgtccacgataccatgaatataattaagtctcgacgggaattgaacttttggctaacgccaaatttcgcgcctttgcaaacagagtgcaaacaatagggggctaaaatcctttgtttttgcttgattttgcttgtacaaggtttatagagaacatggagaaaagccttgatataactgcattttctttatccctgttgatagggaatatatgcactgggtccatctcctaagcggaaggccagcggttcgaatccgctcaggaacactgaatacaatgccgaaaaccttgatgtgagaggttttcggttttttaatttaacaggaaagttctcctgttaaattaaaaccgctcctcggaggaccacaactctaaagagggcttgttcactaagctcgttacacttgctaagtgagctaatgcctgcggcggtatggaataatgtcgccacagcgacccgccgcaggcggtgaaatatgtaatagctatctgactgatgaataagcaatcaatggctgtaaagtaaaaaagattatttactattttatcagggttcgttcctgagccggaacgagccaatcaattccttcaacagcagcgcctgtgcggacagttcttcgctggccgccgcgctctcttcggcggtagctgagttgagctggacaacatcggaaatctgcgtgatactctgatgtacctgttccacggagcgggcctgatcgtcggaagctgaagatatctgctcaataatcatctccacctctttaataccgtccaggacattcttgagagagacagccgtttcaccagaaatacgcgttccgtgttccactgcttttaacgaagcggcgatgagggacgtcgtgttatgggacgcttcggcgctctttgcggccagattcctgatttctgcggcaatgacggcgaaacctctgccgttttcaccggcgcgggcagcctcgacggctgcattgagggacaatatatttgtctggaaggaaatatcttcaattgcgctgataattttacttatctcgttggagctctgtcggatgtcctgcatagccgacagcatctcctgcatgcggcggttgcttatctcggcttcatttaccaccgtagttacgctcatattggcttttgaagtgctgctgacattggatataatctgctgggagatgtcctctatgaccgccgccagttcctctgccgccgccgcctgttccgtagcgccctgagccatcgactgcgcgccgcaggccccctgttcggagccataggctacctgctgggcggatgagctgatttgggaaagcgtataattcagggattttataatctgctccagggcatccctataaaagaaaaatctcctaaataattaccgtctacggacagtttcagattgccccgggaaatttcttccaggacgcgtgtgacattatgaatcatatccttgagagcggcaacagacgaacggatgctgccggccattctgccgatttcatcatctgtccggccgagaggaatgtcgacgcccagattaccctgtgagaaatcttccatgcttctgctgataccggcaagaggtttcatggtacggtgtacaataaacacgataacagttgtaagtccggccagaattatgagggacagcacgcccagtatggtgagcagccggttgcgtgtcgcatttacctcagaaatcgggagcgtggcgacagccagccagccggtggttgcgctgtttctgaacatggaggtataccggatgccgctataactgaagttgagaacgccattataattgctttgaaccttatctttatactcctgggggatatcgagttcggaaacattcctgcccgatgcgctcggatcgtcgctgtatatgtaatccgaattattggagataagttcaagataaccgtgttccccgactttgatcgatgagattacctggcccagactgcttaaatagacatctaaaccggtcagaccggcaatctcgctgcctgattcagaaaaaaccgggtttacgatcgagacaatgatctctccggtggcgggatccagaaagggatcggaaatcacgatgtccttcgtggtaagcagccggtggtaccattcattaccgtcaagatttgccgcaacggtactgccgtcggaaagcagataggtgtcagtatcggaatcagcggcccaaacctgcagcactttctcattctgcataaggcctaacgcgtcggacaattcttttaacacggcatccatattatcataggtgcggatgtcctgaggggaagagacggcctcaaagtagttctgcagcgtggaattctcttcaaacgttcctgccacggctattttccccctgaaaaaatcatcgacggaagccacggcgtaatcggtctgggcatcgagcagccggttattcaaatcggatatggtaccggcagtggcaaagcaggctattagtaccagtataatgagtgagggcaccagaactgtcaggatactgagattgattttgaatgagatggtttggttccatttagtggtctttttccggcggaaaggttcctctccggatggtgtggcggttttttcatacatagtgtttcccccgaaatttgaattgatgtacagtacgataaaaagcatgagccatgaacgtatcactgccatcaatgaataaggctatggtaaagttgttcaatctacgaacaattataccatagcctttttgatattagcaatgtaaatccgccggggtaagcttggctattgattatgggagagctgtctctgtgttaaaacaatggttcagcattttcagaagctcctgaatctggatgggttttgataaatgcccgttcataccgatttgcagtgacttgcggctgtcctcactaaaggcattggccgtcattgcaataatcgggatggttcgggaatcggccctgcccatggtgcgaagtctctttgtcgtctcaattccatccagaaccggcatatggatatccattaaaatggcatcatagtaaaaaggttcttttttacagaacatctgaagggcaatctgcccatttcctgctgtctctacgaaaaagtcattcatttcaagaagggtctgggctatttcacggttaatttcattatcctccacaactaaaagccgtttgccgttaaaactataggagggggactcatttaatatttcgtgctggggtgccggaacctcgctgtatgggagagagacggtaaaaaagaattcggagccgcggccgggttcactttttacatccagaacgcctcccatcatctgtaccagccggctggagatggcaagcccaaggccggtaccgccatattgtgaagagatattttttgctccctgttcaaacgcgttaaagatagacggcaggacttccggggaaatgccgatgccagtatccgccagtgaaaagcgcagggccagcccggtatcttcttctttaacaggatgaatatgaagagtaatggaacctcccacatctgtaaatttaatggcatttccgatgagattcagcagaacctgttcaagccttagctgatcggctgttaaatgccgttcggtacggcagtcattttgtatggtaaaggaaagtccctttgcttcggcctgcatccgcaccatctcgtctatggaggacagaaaggatgaaagaagcatcggtgttgggttcagttccattttcccgctctcaatccgggacatatccaggatatcattgacaaggtgaagtaagtacttgctggagttatcaagtttttccagacattccaatacctgctccttatttccggcggcagaacgtgcgatagcggtcataccgacgattgcattcatcggggtccgtatttcgtggctcatacgggaaaggaaatctgtttttgcctggctgacggcatcggcacgggctttcattacaaaggagggaacaattttaccaatctccgccagcacacggcgctgttctttcgtccagatataattttcctggcagacttcgaatccgatggcgccgatatagacgccgttattccatattgcaaaatggaggcaggaggggaatggggaaatctctttgttcggacagacatcgcacagcccgtcggatgcataccgcatggcggcagcctcgtatttttctcgggtaatataataaggcttatttatatgaatataagacatatcatttgaccactggtatgtaaaacggcaggagaggaaagaaggatcaatttcaagcagggatacacggtccatatgataaatctttccaattcttgcgaacaacagggagacggcatcctccagatttttcgatttccccagcagatccagagcgaaggatatcagattttctccgcgctgcgcatcttcctgttcaatagtattgacaatgtatttttccgtatagagattggtcagcataactccaagctcattggaggtgtcgagatagcaggcggcgtgtccacggcagcgctctttgacataattcagcgtactttctgcgcatcggtagaggccgctgtagttattgacgacttcggtggaacacataccgatactgacgctgatccggctctctctgcccggtagaatcatgagattttgaacctggtcggcgatatgggggccgagcacggtagcctgttttttatcacaattcctgataaacagcataaactcatcgccgcccagacggatctggagatcctgttcagaggtggagccgcgcaatatatcggccacttccagaaggacggcattggcaaaggaggttccctctttctcattaagctggccgaaattgtccatatccaggagcatcagaacacagttttccccttccggtttttcctgcatacatttctgggccagccttgtgccggtctccttattccataagccggtcaggctgtcacgggatttcgcgttttccagcgcgctggccattcccttctgattggtaatgtcttcaatgatacccacaacaaagtcgggccgcccgtcttccgtccaggtaacggttgacataaattcccggcaccaggagccggagagtgtctggaactctgcattggcagttcccaatccgttatggatggcctcatacatttcccggcaggcggcgtggcaggaggggacgacaaaggaatccaggaagctgtccggcatctgttcataccgttcgctgcagtgatagtattcacaggtacggcggggaatgacacaggtccggattaacggataataataaaattcacagattgatgtatgttctaaggcaatattcaaaatctggttgcgggcttccagttgtgccgccagccggtgattttgcagtattgcctgcttattctgatcgatattgagaaaaacgctgtggttcagcagatcttcacccgtgtcctgactgacggagccggagacaccctgtaaaacactgggggcggacatatgcacagcggcaattttccagccgtccggagtatggatgcaggcagcgcttatcctggcctttaaagtgaagagcgggccggaagagacgggtctcattattgttaaatcagccataaaaacagcgtcatcctgggataccgacgtctcacaggagttagttaattccggcagatagggctccggatcctgggagtattcttctttcagggcagcctccaccttctggataccacacaggctgccatcggttccgatgccgatccattggatttcatctgtcagaagagagaggacagtatttatgtccctttttttcaaataggcgtctaaaaaagctctgacagtcttttcagctgcgccgttcgttatgctcatataaagttcctccagagccagagcagttgctgcccggccatgtgatttattggatttgatacgctgtattttataatttctgcatgtgtttttattgatttaacaagacgggattttgcaatggagatttagttgaggttgggggacccgtgagccgtaactatgcaactcatggttgcatcatggtaaaaatgcaatctgctatttttagataattatatctgctagaataaaatcattagaaaatattatgattccggaatagtatacgaaatttaaaacgattgaaattctggtgtctgatacgtgacatggacgtatccggcttcaggtaaacagggagaaaacaggaggacagaaatgccgcatattttatcagaggaaaacagagagattcaggaaatggccagagagtttgccgaggcaaagataaggccggtatcaaaggagtacgatttgaagggggaaacgccgctttcggtgtataaagaagcagccgggctgggatatacgtccctgtgtattccggaagagtttggaggagccggacttggcacatttgctaatattcttgtagcagaggaatttgccagggcagacgctggattctccgttgccgtacaggccagcactttggcgatgaagccgattcttcttgcagggacgaaggagcagaaacagtatgcagctgacgcgctgatcaacggaggcatggggtccttttgcctgacggagccggacgcaggctctgacgcgggagctatcaggacaaaggcggtaaagaaggatggggagtacataattacaggccgcaaatgttttataaccaatgcaccccatgctgatttctacgttgtctttgccaagacggagccggacgcgggaacgaaagggatttcagcatttcttgttgaacgcggcagagaggggctttcgattggaaaacacgaggacaaaatgggaatccgcctttccaccacggctgatgtgatactggaggaagtacatgtaccggaagatcatcttctgggggcagagggaaaaggattcaagctggcaatgcaaacactggacagaaccagactggaatgcgcggccatggcggcggggctgagtcagagagctattgacctgagtgtagactatgcaaagaccagggtgacattcggaaaaccgatagcgaagctgcaggcaatccagtttatgcttgcagatatggaaatcaggaaccaggcggccaggagccttgtatatcagtgcgctgcgatgattgacagcggggctgtggacggaaagatgaacgcggttgccaagacattctcatcggaagccgccatgcagaacacactcgatgcggtacagatattctccggatatggatattccagagaatatgaagtggaaaaactgatgcgtgacgccaagatatttatgatttttgagggtacaaaccagattcagagaacggtgattgcgggacatttaataaaataaaaacagtatgaacagagaggaggacgacccatggcaggcgttttagaggggctccgtgtaatcggccttatacccgttatatcgcagggccatattgcggcggccccccctccctgtcttcctatagcgtcgtcgctttcggcaggctgaaaataaattccgttccaacgccttccgtactgaccacatcaatattttcaccgtgggcctgtataatttctttgacaatggccaggccgagtccggttcctttcttgtcttttccacgggatacatcgctcttataaaaacgctcccatatctttttgatattattctttgggataccaacaccggtatccttcaccgacacaaataccttctcatagcgtacagaggtctggatatagatgaccgaatcctcccggctgaatttgatggcattgtcaatcagattgtagagaacctgctgaatcttgccgagatcagcgtagaccatctggatggaatcggagaaggtgagatcaaaagtgattctttttgcactgcatgtaccttcaaaggtagccgccgtatccttgacggtcctgttgatatcgaaattagtccggctcagatagcctttgctgtccagtgaattgagagtcagcatgccctgggtcagcttatttaagcgctcggtttcggagatgatgattcccaggtatttttggtacagctccggcgggattgtcccgtccaggattgcttccagataacctttgatggaggtcagaggggagcggaaatcatgggagacattggcgatgaactttctctggtattcttccatatcattcagttcgctggacatatagttcagcgtgttagccagatagccgatctcatcatggctcgttatttttatgttgtgtgacagatttcccgccgcgtactcattggctgcataggttattttcttgagcgggaaatagacgattttcgtaaatatcagcaagataatcagggacagggcaaaaataatccccgatgtaatgtacacaatattcaggaatccgttctgttccgccttaataacactgataggaaggtgaatggtaatataaccgtaggtattcatgtttcccgtaatgggggaggagacagacaggacatcgctgtcaaacatcccgtaataccggccgatggtgtaaagccggtttccctgggcagtcggatcaaagccttccacggcagtgccggctgctttccggctgctgtcggcggtgataatcccgctgtggtccataatccagatcctggccttcatgtaggttgcgaccgcatccagttgaggataagcggttgccaggtccagatacttcccctcatataccttgctgcagttatcggcaatcatggttgcctcgtcatacagggcttccgccttctgctcaatcagatgttcataggtcagattagatgatacggttgctatcgtaacaaaacccaggaagccgaacagcagatagcccaggataaatttgtaataaagtgtatgtgtcatgacattcctccgtctcgttagtataagacgctgttcagggaataggtgaggaagtccaccagttctttgatcagtgttggttttggataattatttcttacggccagcatcatcggatagggaaacgcattgtctttaaatggtatggcccgcagttccggatatttgggaaccagattcgacgtattggagtcgatgcacaggccgcacaggccgtcttcactgcacagcttgtacatgtaaaccgtgtcgctggtacggcgaacgtcgggggtgaatccctccgcctggcaaagccgaaggaatttattgtacgcaaaatcattgatgcataaaataaatttttcatttctcaaatctttaatttccagctcctccttcgatgcgagaggattgcttttttccacaatcaaaagacgtctggtggagggcaggctgtaggtgatgaagccgtccgtattctcataatcggatatcacgacagcatccagcgtccccgctttcagacactttaggccctcgatatagccgtgctcatacggttcaatttccgtatgcgggtgcagctctttaaaatattcccagatcttttttgaaccgaagtaaatcagtcctcccgacaggccaagccgtatttttcccttgtggcgcgtggccgattcttccagcttcagatttagctggtcccattccgcaagaatcgggcggctgtcctccagaagctcctggccgaactgggtcggtatcatgcccttgggggtccggtagaacagggcggcgcccagttccttctccagtaacgacagggatttgctgagagcctggtgggagataaaaagcacttccgaggcctttaaaagactgccgctctcacatacctgcatgaaataacgtaactgtcgtatttccaataatctcaccttcccgtattgtacacacgtatctatggtatcttcaccgtactgcctgttttggcaggatgaactgtgacctatattatacatcactttatttttggatgcaactttcagttgcattcctgtaaaaatttaaactgctatttttagaaaattcgctctgatacaataaatacatagaaaattaaaaggacggtggaagaagaatatgaagattattgtatgtgtaaaacaggttcccgatacaacggaaattaaaattgatcctgtgacaaacacactgatacgcgccggtgtccccagcatcgtgaatccatatgacgcatatgccctggaaacggcactccgtttgaaggaacgctatggggcggaggtccttgttatttccatgggaccggagcaggccaaagaagcgttaaaggaatgtctggcggtaggagcggatcgggcatggctcatcagcgacagggcgttcggcggttccgacacgctggcgaccagctttgtactgtcccgggcagttgcgtggctgagcaaagagctgggagacgtcggactgatactctgcggcaaacaggcgatagacggagatacggcccaggttggaccggagatggcggaacatctggacctcccccagattacctacgcatccgatgcagagctgtcggaggacggggttttagtgaaacgggagaatgacgacggttacgacatgattaaaacaaaacttccggcagtggtaacggtaacgaaaatctccggggagacaagactgccgtccatcaaagggaaaatgagggcgtccagagccgaaatccccgtgcttaccgcccagacgcttgaaatcgatgtggaaaaatgcggcctgaaaggatcaccgacgaaggttaaaaagacatttacgccggtcaggacaaagacgggaatcaaggtggaaggcaagacggctgcggaggcggcagcaggtatggccggatttttagatgagaaaaaattggtgtgacgattcgggagggaagtaacgtggaacaaaagcaggaatataagaatatctgggtatttattgagacagaagagggaaaagccaaaccggtcggattcgagcttttaactcccggccggctgctggcggacaaaataggggaaaagctggttgcggtgattcccggttacggcgtcagggaagcggcaagacaggcggcggcttatggagccgacgaagtgcttttcatagagggggaggagtaccgaaattacagaacggatgtgtatgcggattgcatgacggagctggtggagagacacaggcccctggtaatcctgatgggagccaccaataacggaagggacctgggaccgcgtcttgcatgcaggttaaagaccgggcttacggccgactgcacggcgctcgatattgacagcatgacaaaaaatgtggagtggacaagacctgcatttggcggaaacctgatggcgacaatcctctgcccggaacaccgtcctcagatgggaaccgtgagacccggggtatttaaaaagcccgtgccggacgaagacggcagcgcggcagaacagaagctgataggggaaagtgccgggataaagccggaacgtatcaggacggagatcgtggaacgaatcaaagaagtagtccagtcggttaacctggaagaagcggaaatcattgtatccggcggccgcggaatcggaaaggctgagaatttctcctatatccgtgaactggcggatgtcctgggcggggcggtcggttcttccagggcctgtgtggacgtggattggatcccccgcgcgcatcaggttggacagacgggcaaaaccgtggctccaaagctctacatagcatgcgggatttcgggagcaatccagcacctggcaggaatgtcgggggcagagacaatcgtggcaatcaacaaggacccggatgccccgattttcggggtggctgattacggtatcgtcggcgatctgctggaagtgattccggaattaatcagggagattaagaaggtcaaagagatttagaggtacaccgtattgcaggagggactcgctaactgataataagcccctgaccgcatcggctgagacgaaaggaaagaaaggataagagataatgagtgaattattatatgaaaagcagggaatgattgcaaaaatcatcatcaacagaccggaaaagagaaatgcattaaacagcgccgtaatccacggtatcgacgaggcattaaagcaggcggccgaggatccaaaagtacgcgtcgtcattctgggaggagccggtgaaaaagcgtttacggcgggctttgatttgaaggaggcaatggaacataacattacgggcgttgtggagcgcagggaagacacctcggaggaaattaaattcttcatgcggatgtggaactttccaaaaccaattgtagcggcaatccagggctactgtatcggcggaggaatcaccctcgccatgctcagcgatatggtcatcgcttcggaggacgcctcatttggaaatcctgaaattattctgggatacgtgccggaatttccgatggaagtatggaaaatgccgtttaacaaggtaagggagttcttctacctgagcaagttctttacggcagcggagatgcgtgatatgaatgtggtaaatcaggtagttccctatgagaagctggaggagacggcgatggccgtggcaaaccggattgcccagataccgccggagagcgccaagataatcaaatattcgctgaacaaatgttatgagctgcagggctttagaagcactatcgattttgtgtccgaaatgttcaacctgggcagaatccacatgcagacaaccggggtagatgaattcagaagtgacattgcagagggcggactgaccacggctctgaaaaaacaatacggtaaataataacggaggctaaaccatggaacgattatggaaagtacaatatgctgacagactgattacggcgtcccgggcagctgctatgatacagaacggggacagcttctgctgcggagccagggagccggcgggtatcctttcggagcttggaaaaaggaaggacctgacggatgccgtctactatgccccggaagaagattttccgcagcttctgcccaacatgggaagggggctgacagtttataccagctttatggacggaattaaccgggaatatatcaggaacggacggatgcagtttatcccctgcggcttttccggttttaccaaagtggcgcttgagaattttaagtgccgggccgcaatcacctgcgtgtcggctcccaacaaggacggtttcgtctccttcggtaattctgccgatatgatggcagatgtatgcagggccgtcccgcttgcgatagcggaaattaatgataagctcccctttgtacacggtgataatgtgatgcatgtttccgaatttgattacattgtggagggggacgggtatcctctgaatgtgggccggattgacgactccgacgaaaacagggagatttacaaggcaatcggcggttacctgtcggaactggtggaggatgaagccacgctggaggtgggaatcggaagactgaattcctctgccatgatgtatctggaaaatgcgcatgatctgggagtccacaccgaaatatacggtgatctgctgatgaaccttacaaaaaagggactggttacaaacaggaaaaaatcattgaatccgggagtttccgtctgcacccaggtggttggttcccaggagctgtttgattatgtgaaagataacctggagatccgcctggactgctgcaaccatgtcctgacaccggcagtaattgcacaaaataataagatgacggccatcaataatgccgtacaggtagatcttctcgggcaggccaatgccgaattcctgaaaggcagccagcattccggcatgggcggaatcggagattttgcaacaggggccgtgagctgtccggacggtaaatcgatcatcgtgatagagtcggtgacaaagaatggaaagtattcgaaaatcgttccttactttgagccggggacgccggtatctctgagccgcacgatggtggaatacgtggtatcagaatacggaatcgcggttctggcaggaaaatccgtacaggagcgcgcccgggagctggtaaatattgcccacccggctttcagggaggaactggaatatcaggcaaaggagattggaattttaaattagagggggaagggagttacagatgagcagtttgagtgtagtattagtgattctgggaatttacatggtggtaatggttgggattggccttgcgggaagaaagtacggcgggagcatgaatgatttcatgacggccggaaagcagggaacgcttctgctggtgaccggttcctacatcggttcccatatcggaaacggtattgtggtaggaggcgccgaatacggcgctgtatatggaatcgggggaatgtggttcggagtcggcgcggctttatcctacctattattttcggcagttatgtcgaggcgggtataccggggaaattgtgttacgctgtctgatatgctggaacagagatacggcgataaggttacgacgattctgatggcggtcctgaacggagcggccaatacggcggtaatggccggacaaatcatggccggaaagcggctctttgaatatatcggggtaaacccggtgcttggagccattatcacaacgctaattgtcattatctactcgtccatgtccggactctggggcgtaatgatgaccgatgtaatccagagtacggttatatttatcacagtgattgtcacggttatatttatcggaagtcagggcggctttcagcttatggctcagaatctgccggcagaaagcttccagatggttcccttcagcatggagacattcatcatgatgctgggtccgacggctctctatgggctggtatcgtcagccgcgttccagcgtaccgtctcctgtaaagaggaaaagacggcagtgatggctccggtcatcgcggcatgtatgattattccgtttgtagtcctgcctgtactgattggaatgtacggaaaggcattgtggccggatgcggcaaacggaacgattattttccaggtactgttcgaggcaatgcctcccgtcctggccggacttttaatcgcttccatctgtgctgcggttatgtctacctgtgacggcggtcttgtaaccatcacagccaatattgtcagcgatatctactataaacatataaatcctcaggccagtgagaagacactggcaaaaatgacaacctggtcaacggtgattgtcggtttaattgcccttatcctgtcattgcagttttccagcattatctccctgctgtccatggcctatacttttatgacggctggaggattggtaatgatagcgggcggaatcctctggaagaaagggacgacccagggtgccattgccagcttcctgattggaattgcctgtgttattgtcaataaaatgggattacagatgccgatggcatccatcttcccgatattgccgtctttgattgcctatgtggcggtcagcctgatgacacagccgaaaaaaggctgagccattttgccggtgcgaaagaaaacaggggaaggataagactcatccaatcaccccacaaccccgtccgccggccgtcccggcggcgtcctcacctgcttaacaaaacctggaccaggaaatttcaaccacctaataatactcgacttatgtctcataatgtggtaaagttatatagtgtgacttgataccaaatgaatgattggaatgtatagttatgggacagtatattgtattagacttggaatggaatcagagtcctcttgggaaagacggctccatggatcggctgccgtttgaaattattgaaatcggcgcggtcaagctgaatgctagtttacaaatcatatcggaattccgccgtctgatccggcccagagtataccggcagatgcactttaaaatttctgaagtaacccacatgtcgatggatgaactgaatatggaaggcgaggagttcggcaaggccatggaagagtttctggcctggtgcggggacgactataaattctgtacctggggttccatggatttgacggagcttcagaggaatatggtgtaccatggcctggatattcctttccgaatgccgctgctgtattacgatcttcagaaaatttacggactgattcggggagataagcagaaggattcgctggatacggttgtggaggagctggggattgcggaagacaggccgtttcaccgggcgctcgatgatgcgtattataccgggcgtatcatggccgagatggatttttacagcatggtggagtatgtctcagtggattattacaggccgccggagacagaggaagatgagatttacctggaatttccgggatatgcgaagttcgtatccaggatgtatgatacaaaagaaagaatacttgaggagcgcagagtgacggacatggtctgctacaaatgccgccgtacactaaggaaaaagattagatggttttcctcaaaccagaagttctatttttgccttgcttattgcccggaacacggttatatgaagggcaaaatccgcattaaaaaatcggaggacggttccgtctttgccgttaagacgacaaagctgataggagaagacggtgcggctctgattacgaaaaagaaggaagaagcaaaaaagaagcgggcagatcgcaacaaagcgaagcgggcattcagaaataattcggataaatctgtatcagaagaatgcggaacactttaaaaagatagtgggagaatatcggaaacggtattctcccatttgtattgaaggcggtgacctgcgcggggagcatgccggttatcgctatagattttcaggcgcgccctggcgctggctgaaactgccggcaatccgtaaaaactcgtcggtcatggcttcgggagtttccctcatgccgccctcaagccagcagagcagcatattataaaacgcgccggcaaaataataaagctcatattttgcaatggaattggccggcatatcgccgtaggcatcaatctcacagtctgtgataacatccagcagagtggtggaaatctttgcatggtgaaacgccagcacgagatcggcatgttcacggtagaaccggaacttatacagtatcatctccctgctgtgcggactctcagttaaggccggcattttttcatgatattcaagactcagtttatggattccatagccgataatttcttccaccgatttaaagttccggtagaaagaagcccgggcaacaccggatttttcaattaactctgtaactttaacctttgaccagtctttttcgcctgcaaaatcaaccagtgccgagaataaacggtcttttaccagttgattggctatttttcttttatccatgatgatacattttcccatattttgtctcaggttgacgcattgacatcaacgatctatgtgatacaatatgtatcatataaagatttctttaatctgtcaagaggaggagcatatggttttttattttagtggtacggggaacagtcagctagtggcagtccggatagcagaaatgacaggcgataaggcagtatcgattaaccgatatatgaagaagggagaaaaagcggtgttccgttcggaacgcccgctggtatttgttgctcctgtatattcctggcgtctgccaagggtggtggagcaatggattatggagaatgattttgaaggcagccgcgatgcttattttatattgacctgcggcggcagcggcggaaatgccgctgtttatgcggaaaaactctgccgccgaaaagggctgcgttatcgcggtctgtgttcggtgcttatgccggaaaattatctggctctgtttcccaccccaggtgaatccgaaagccgggaaattattgaaaaagccggtccggtcataaccgatcttgcaaggcagattcaatcaggagagacattgaccgcgcagccggtttcccttgtcggcaagattgaaagcggccccgtcaatccgctgttttacagactttttgtaaaagataaaggttttactgtttctgataaatgtatctcctgcggaaaatgcgccctgcgatgtccgctgaacaacatatccattgaaggcggaaaacccgtatggaagggccgctgcacccactgcatggcctgtatcgggggatgtcccacggaggcaatcgaatacaaggctaagtccagcgggcagcgccgccattatatcatggacgattctctttgctggaagaatgaatgtccagaaatgctgtagttctccatccggccagaaacctagtaacgctattttctttttcgtcctttactggcgggagctttccgttcccgctcaggggaggaaattctcttctgctgcatcatcaggtcaaaatcagcttccgaaattcccgtttcctttaaccgctcggctctgcgccggcgccgctccagtaaagccgcctcttcctgcgccctgcgccgtttgaagaccaatacggcaaatgtcccggaaccgccaacaacaacgacgacggcgagaatcttccagaacagcgacggtattttgagggaaatactgaatttattgccgtcctgttttgacggctccgattcgggcggctgtgctgctccatccgcgtttcgcgctgacggtcctggggccggttccttgtcctccggatgtgaaatatccggattttcagcagcgggagccaacgcagacggctgcacttcaaggagcgcctggggcagagccaaaccggcatcggagacagcatcctttaatgtaaggtaagcgtgtccaactgttctttctcccagcaggtaatttacgcaggcgattgcccctgacggagctccggccggcagtgcgtaatcaagagatacggttgtttcggaaaagtccgctgtaaccggaagaataattttactgtccggatcaatggtcagcacctgcttttcagaggtgggcaggccggatattttcaaatcgtcgccaatggtagaaaatgttttatcataatcggctattcttaccgctttaaaattattaaatccaaagttcagcaatgcctttgtgtcgctgtactgggtcccggagctgtgcaggatgacggtaacaaacttcgtctctccctgctgtgcgccaatgaccagcgtattgagagcaatggaggtatagccggtcttgcctccgattacatcgggacggtactgatccggccagtttttcttgctcattttgttgccgggggaaattccctggccttccgggttcttcttattgggaggcagctcatagtatgtagttgccactatttttgaaaaatccgcgttttcaaatgccgcctttgtaatcagcgccatgtcgtaagcgctgacataatggttttcatcattcagtccgctcgggtttgaaaaatgggaatcctgacagccgagctcggccgccttttcattcatcagcacggcaaattcttccgttgtgccggaaatgtgttcagccagggcattagccgcttcattggcagactttaaaagcagggcgtaaagacagtcttttacgctggcggtatctccggtatcataaccggcgctgctgctgttggactccacattgtacaccgcattctgggaaaaggtcaccgtctcatccatcgaacagcgttccagcacaatcaatgcggtcaggaccttggtgatactggccggggcgtacgtggcgtggatattctttccatatattacggcgcctgagttggcatccataataatacctgcatcggactcaatggacacgttgtccggccagtcggctgaagccagcacggtggacggacagagccaggccatcaaaagcagggataataacatgcttataatttttcgtttcattctataatcaaatcctgttcttgttaataatcagcgggtttcggtcactgtatatattaatatttgtaatataaacgtaattactatttaacagtatataggaatccgaatttcatgtaaagaaaaattgtccacatgtggaaaagtctgtaaattccatgttattgtttacaccatgcataaagaggcatgctgtgaaccaatgtcacttagttaagcaggtgaggacgccgccgtaggccagcggacggggtggtgggattgtccttacggctgtttttccggcgtccggcggataaaaaaaatacatatggcgaacaacaggatggttgccgctgcaaaagtgacaccaattctggcagcggtatccacaaaaaatggttccgggacaatgtttatcaacaaatcggttgatggatccagaatccacaggtcattggtaaagaatattttgtggaaaagtataaaatatttcgtgaagtctgtggatattatggctgcaagggcagcagttaatgcaaaaaacagcgcagtaccgatacagagcatccgaggcagcaggcgttttatatcagctttcgtccgccaaagcagtgcgatgctgagaaggataatcactgcacaaatcctgcggatggcgatcgcagctaaaaagagatgctgcacatcgaccatatgggcgatctcccgttcattgaaaaactcccgctgaacgcctcccacagttgtggggacatgaagatccgccctcttaccacggagaaaggccatcatctcctgcgtcacgtccagaagatcctccatttccatatttacatcctctgcaacaccatatttttcatactctttttcataatagcccggggtccagtatgcgacagcctctaccgatgtgatcagaaaaataatcatcaggcagaatgcgcacaggataccgagaaaatgctggaaatatttcatcacttacctggcagaaacaccggcttttacggaatatttctgcggctcctttctcagataaacagccgtccgttaatcaagacggcaacaatcgctttgttccataatgtaaagtaccaatagattatagcagaaagccaatgcggggaaaaggtcagtcgggcggaaaaattgtgaatttttttacagccgtccccggaagaccttgcaaagaaccgcaattctcctgtatactaacagcaaaaggcagaaattcaggaggatttatgataaaagcagttatatttgatatggacggggttattatagacagcgagatggagtacttaaaatatatctatgagttcgctaaggaaaagaatccggacatcctgatcgaggatctgtacggaacggttggaacgacaaaacgggactgctggattgtggtggagaaggcggtggataacggtgaatcctgggaggagttaagacagcagtaccgcagccgctgggacgaggtgtttgagttagtggattatcaggccattttccgcccggaggttcttacggtaatggactggatacgggagagaggatttaaactggctgttgcatcctccaccaacatcgagcaggtcacaaagatattgacaatgaaccatgtggcagagcgtctggaactgatggtaagcggaggaatgttcaaaaggagcaaaccggatccggaaatctatttttatacggcagagaaactgggggtaaagccggaggaatgcctggtgatcgaagactccaccgtggggattaccgcggcccacagcgccggaatgcatgtggcggctctgatagaccgccggtttaactttgacaggagtcttgctgactttgaactgggaagcctgaatgacatacctgggctggttgaaaaaataagcggtaatgcagtccggcgtgccgtttatccagattggctgcaaaatatctgattgacaacggccacagccggattttgtgcctgaatggaccgtcttacatatccgggcacatgaggaggcagggctgcccgtttttccggagctgattcgggaagtaccggtagcggaaagcaatataccctatattctgaaacagatgaaacaggaggacgcgggatttaccgcaatctttgcattcagcgacagcatggcctgaccgtatcagccgtttttttccggtgcgaggagactgacggccgcatataccgccgcgcttatcagaatgctggaaatactggcgtaaggcaggcgtatcagttccagcgaggcggccagcgaaactgccatgcctgcaaaggcgctgtacagcgctccgcggctggtgccttttttccagatgacgccgcccaggaagggaacgagacagccggaggccatcaggctgtatcccatggagagtacccggataatgtcgttcattttcagcgccagaagtattccgatgcagcagactgccatatcggccagaagcatcaggcgccggcaagttctgctgtctgctccgggatttaccataccaaggtagatatcatggacaaagtttgcggccacggcaatgtaagcgctgttgcaggaggagaccacggcgcagattacggccgccaggatcacggcggccacggcggtgggaaggcgcgtgagcagcagagaggaaaatacattttcagcgggaataccgggaaacaaagcgcgcccgtacatgcccagcaggggcggaatgaatgcgaccgggatcaatgtcagtccggccagaagataaccgcctctggccgatttgagggatttggcagaggcggcgctctggaatgagatctggttcactgagcttgccaaaacgatgggagcagtcatagagactaaaaattcggcgccaaagggcgctagatgaaagctggaagcaggcagagcggctgccagtaccccaggaccgggagcggacatcatcagaaacagggctgtggacattccgataaagataatgacgctctggatggaggagactgccatagacccccataaaccagcggcgtttgagtataccagcgcgataaccgcagtcaggacgacaccccactgggccggaaggcccaatgtcaggaatatggcccttccggccagaagctgcccggccagcagagaaacgctgcaggagatacttgcggcagtataaatcatacgggtcgcatgaccgctgtaacggcgggcaaaataatcggccggggagacatagtgatgggtgcggatgaaacggcacagggccgcagtgataaagtaggaaagcccgcagccgataccataccaggcgcccgcaatgccgtagcgggcgccgtattccgcaccgccgatgacaaatccgctgccgatttggccgccgatggcgctgcctgccagcaaaaacagggaagtttgaccgggggccgcgatagtgtcctgaaagctgcgtatccggcggcttgctcgcctgctgatgagcagcatcgcagttccataggacagcaggattaaaataacaatggacggggtggtcataaggtgcctcactttcggttgaataggtgaatttgggtggagtagaatgagggtgctgcaaaattaaagcagcaccctcggtattagttcgttcgccccgcaggggcgcctgcaaaattgcgttttctatgcggcctgcgcctctgtattcttgctgcaaagacttacgataatgtaagcgatggcagacggaatgacagggaagattccggccggtatgatactgccaaacgggaatacgacaccggtccaactgataagtacggtggcaacgccaacgatggaagcggcaacggcgccggctgcagtgcctcttttccaggccaaaccgccgacaaacggaacgaaacaagcggcagccaggaaggagtatacggagttcagaagccccaggatgctgctggcggacagagccagagcggttgaggtagccatgaagccgatattgactcccaatgtaattttctttaactgggcctctgttgggtttttcttcagcgtgccctgccagatatcgcgagtcaatacagttgacatcgtgatcaggccgcagtcgatggtggacatgcaggcggccagaacagcggcgataatcagcgcgcagacaatggcgggaagttccatcaggatgacatcgaagaaagcgctatttccggtggcgccgtatttaaaggaaccgtaagagccgataaaggcgggcatcagagccagcggaatcataacaaggcaggaaagatagcaggcaatacgggaaatcttcgcgctctttgcggagttaacacgctgataagtcggctggtcggttacgatacctaaaagcagaggcagcatcatgcctgcaaaaccggctgcggacagaccgctgaaatccagagaggagcttgccaggttaccggcctgaatggctgcgctcatctcgcctacagcgcccttgctgaacaggacaatcgtggtggcaacgaggccgaccaggataacgcctgtctggataacggaggtggcaaaagcgccccacaatccggaaagctgagaatacagcagaaccactacggcaatagagatagcgcccacgttgcccggcagcccaagcgcttcaaaaagggccttgcctgccataatctgtccggcaattaagccgatggaggaaatagcggtactcaaatcatagatagtgcctggaatttcattgtgataacgtttacgggtatagtctgtcatagacatatagccgttgttataaataaagttattcagaaaaagagctaccacgactgtggacagcgcacaggcaataccgtaggcggcgcctgcaagtccgctgacagcgccctctgcagcgcctccgaccacgaaaccgttgccgatctggccgccgattgcgcctcccatcagaagcagcactccggcggagcggcccatgcttaaatatccttcaaagttgctggccttgctgcggcccatccatccaatcacgaccattgctgcaaaataaagtattaatacaattacgatagttggaatcattgcgttcatatatcatattcctttctgccgtgttacggtgtgaacacggtctccagattattagggatatgtaacagttcatacaacatgaaatgttacaggatatatcttatctattcaatataagagcctgcatcatagccttcgtgaatcgccagacggacattccgtgcctgcctgcagtcgccgatcttccagaattccggggcacaggagcggaaagactccgcttcatccagcttcggagccaggccagcggcaattatgaccgtatcggccggaagcttgatttctttcccgtcctgctctgccgtaacgccatccggaagaatgccggtacatcgcatgccggtgcgggccgtaatgccaagccgttccatttccagcagaactgcttcgtggtgaagaaaaggtgcatcacggcacagctcaggtttcatctcaaggacggtcactttcttacccagttcacccagaaggatactttcctcacatccaaccaggcctccgcccagaatgactacattctgtccaatctcttccatatgctcatgcatcccgactgcggaaactgcgatttcaaggtccacgcccggcacaggaggcacgatgggatcggcgccgatggcacagacgatggcgtcgggcctcaggctccttgccagttccggcgtcataccggtattcaacatgacggttatcttacgccgttccactctccggattaatacctgcataagctgatccagctttgatttgaacgaaacgtgtccggcaaaacggatagctcctcccagccggccggatttttccgccaggataacctggtgtccccggtcggccagtgtgatggccgcctccataccggcaggaccgccaccgatgacaagcacttttttaggaatgagggcaggacagacgtccttttcggtatattcgcgcccggctaccggattgacggagcatcgtgtcaggcgggaggaatatttgacataggggacaaaggactcactgatacagtggttgcaccgtatgcagggagtgacatcatcggcccggccgccgcggagcttgtcgggcatctgggcatcggcaataatggagcggcccacggcgatgatatcggctttgccttcggccagcacctgttccatcagctccggttcatccagtccgcccacaacggccaccggtgttttaacggcctttttaatagcggccgcaaattccacattgacgccaaatgggtggaacatgctcggaaccatatgctgattggtttccgggtaatggaacgtaccggcagtcacatgaatcagatcgacttttccatccagtaactttgcaaattcaacctgatcatcaatggtcagcccgccttctaccagttcactgccgcttaaccggaactcgatcaggagttcggggcagcgcctgcggatggcatccaccaccatgagggagattcgcgcccggttttccagagagccgccaaatttgtcggtccggtgattgttcagcggggacaggaattcatgaagcagccagccgtggccgccatggatcataaccatctccacaccgcccagccaggccatctccgccgcattggcaaaacaattcactatgtagtctatcgttttttcatccagcgcggtgtaatcttttcccaggtgcccgggggcgtcgctgggcgcccagattggtccgtcgtaatattccggattcgcccggcctccgggatgaagaatctcgattgcgggaatggcattgtggcgcctgatggcgtcagttgccagaatcagggaaggcataacttccggatcatccagagccaggcacaggagatgggatattcctgttttcaggtcaattcgggcctctcccatattgacaatggcggcgcctcctttggcctttcgttcaaatatggcaatgttatccggggtaaagtgagcctggggggtcagattggccaccgacacaggagccgcttcaatcctgttttttaagacggtacggcccagccggagcggctgaaacagatgtgcatacggatgcatggcagtcctccttctcatgtcccattctggtttgagacatattgaataatttgattgcggcacagaaaatagcttgttgatattataatttgatgttttgaaaaagtaattaaataattctgattagtgatttaaaaattctgatattatctgccgctgattacggggatacttttcacacggtaatgtcccgtgcggcaattgggcgcgttactgttcacaaaatggacggcattgcggtcttgtgtttaccgcctgtatttgctaaaatttaaacaaagaagagttgggtagggggaggtacaagaggatggataaatcgaaaaagatacctgaatcactggactattggaaaaagtatattactctgcatcacgtattggcctgtgaactgtcttacagcttaatttataacaatattcgcccggataaggtcggagatgccctggccaccgtagggcttgacacacttcccaaccggtttttgctgcttcaggtggacgattattacaattacagcagcaagatgattatcacccaggagttttttcagaaaaccatcctgattaacctgatgcgggaatgtatggacagcatgggactgaagggatttatggccaatctggtgagtctggacaagataatctgctttttgtgctgtccggaatgggaggggccggatatcaacagacgactgatggaggttgcggagtgctttaaaaaatgtgtccggacaaaaagctcttacacgatttccgtctgtatcagccagcagtgcagcaggctggggcagttttccctgatgtatccaagaatggatctggcgctgagcaaaagctacttctcgggaaaggagttcaatatccttttggaggaggtggagccggatgcggaggaggtccgggaggaggccgatataaataaattttatcctgagctgctggccgcttttgccagaggcaaccgggaccagcttgaggaagtgcttcagggaattgtacgggcacttctggagggacggacgcgcccgcagaaggcgaagatggaaatgatccggctgcttcagcggattgaggattactgtgtgcgctgcggcgtgccggagagctggattcagcggcgcagcgacgcagccatgaccaggatcctgtcatgcggctttgtgggggatacgcggatctgttttctggagttttatgacgaggtgacccaggcattgggagaacacagtgcagacgaggagtattcctttaaaattcctgttaccgagtatattgatacccactatatggagaatatcaggttaggcagcctggcagatatcatgggattcagcgaggggcatttcgcccgcatattccgtaaggaatttggcatgacttttgtccagtatctcacggaatgccggatccagcgcagcaaggaactgctggccgatacctcggtcccgattgagcagatcgcctatagagtcgggctgaacagctacagctatttctgcacctgttttaagcgtacctgcggtatttcccccggggccttccgggccggagccgtccggagcgtggaggcggattccttaaatgttccggagaagaaaagttgaaattttaaaatataatgtttaaatattgaataacatttggaacagcaaactgttaggatgtacatattggcacagaaaaaaaagcgtattctggtaaaaatacacaaactgtccggcggcgcggtgttgttccgcccccgggttatcagcaatcagaatctggctgaaagctgaaaacattttagagaataggaggcctatatgtcccattatccacatttgtttgcgcctatccgtgtgcgcaacgtttacatcaagaaccgtattgagtctgcacccatgtccgccagcggcgacgttccattctatacccgagaggcgtatgaaatgtatgataccattgccaggggcggcgccggtattgtaacgctgggtgaggcaggcgtgcatagcctgaccgatcatgcccatccaaccatgccgcatctggatgacgaaaatcttcttccgaccctgattcaaaccgttgacaccgtacataagtggggagcgctggcttccatcgaactgacccactcaggctgccgcgcaaaaggcgcttttctggcggagggcggttatgtcatcggacccagcccaatggaggcgaatctttacggagacaaagtcatcgaaatggacgaggacatgatgaacatgatagcagatgcctatgcgcaggctgcctacatggccgaatttgcaggctgtgatattgtaaacatccatggcggccatggatggctgatcagccagttcctgtccgacctgaataaccaccgcactgataagtacggcggctgtatagaaaataaagcgcggttcccgcttatgattgtggaccgcatccgccaaagatgcccgaatctgattatcgagttccgtttaagcggtgaggaggataccgagggaggcatcccgattgaagaaacggtggaatttgccaaactgctggatggaaaggtggatattattcatgtttccgcggcgaccttccatgatacgggaaccgcatcccgcatgttcccgtccgtgttctaccccaggggctgcaatgtagaaaacgctgcgaaaattaaggctgtcgtaaaggaatccctggtttccgttgtcggaggcatcaatgatccggattatatggagtctgtgctggtggatggtaaaaccgactttgtcgtggtcggccggcagtttatagcggatcccgactggccaaagaaggcccgtatgggaaaagccgatgaaatcagtaaatgcatacgctgcgagacatgtatcagcgccggctttattcctcatgttccgttttcatccggtgtgctccgctgtaccgtgaatccggcctggggacgtgaatatgagaatacccgcaaagaagagaaaccggaccgtgtaaagaaagtactggtagcaggcggaggcccgggcggcatggaagcggcaattaccgctgcgcgccgcggacataacgtgattctgtgtgagaagagcgatcacctggctgccaacctggactactcaaaacagctgtccttcaaaaaggatattgtagagttcctcaaatccatgatgctcagggtacagcgtaccccaaatctggaacttcgtctgaatacggaagttaccgaggagctgattctggcagagaagccggatgtactgattgccgcctgcggagctgagccggtgaatccgcccataccagggcttgaccggcccatcgtgcatcacatcaccgatctgtataaaaaacacatttccgtcggtaagaaggtggtaattatcggaggcggcctcgccggaagcgaggaaggcctcggccttgcctgggaaggccacgacgtaaccatcgtggagatgagggacgggctggcaaaagatgcgccttatattcactggcgccatctgctcacaaagctgaacgagtccgttcattcctattgttctgctaaggtattgtcggtggaggagaatggggttaaaattgtggatgcagacggtacggaactgcttctggaagctgacaccgttctggtggcagcaggcatgcgcggcatttctgcacagctggatagctggcatgagctggccggggaggttatttttgtcggtgactgccgtaaggcgtccaagattcaggaggcaatgcgcacaggatattgcgccggcctgacgatataattatatagtggaaatgggcaggactttgactcgattcaaagttctgccttttttatgtctaaatacggatcaaaggagcttattacgttttacaaagtatttacaatttttatattgacagttgagcatatgttcaactataatatgtttgacagttgaatatgtactcaactgtatgagagatattttacggatgattctgtgagatataactcttgtctattgatactttataatacgggaaacccatgataaatttaagaaaggtataggtgatcaaatggaatccaataaaaagcgtttaatccgtattgctctgggcgcagttcttttcactgccgcagtcctggtgaatacaaatagttccataatcaaagcggtcctttttctggcgccttttatcatcataggcggagatgtcattctgaaagcgtttaaaaatatcgtccgcggccggatatttgatgaaaattttttgatgagcattgcaaccgtcggcgcatttttaatcggggaatatccggaaggcgtcgctgtcatgctgttttaccaggtaggggaattatttcaaagctatgctgtggataagtcgcgtaaatccattgccggtctcatggatatccgccctgactatgcgaatatccgaaaaaacggacagattgagacggttgcaccggataaggttgctgtcggcgacataatcatcgttcgggccggggaaaaggttcctcttgacggggttatcctggaagggaactccctgatggataccaaggctctgactggagaatcggttccacgggaagcggtcacgggggatacgattttgagcggttttattaatatgagcggactgctgactgtacgggtgacgaaggaattcggcgaatccaccgtcagcaggatactcgatttagtggaaaatgcaagcagtaagaaatccaattctgaaaacttcataaccaaatttgcccgctattatacaccggttgtagtcgtcgttgccatattgatggcggtgattcctcctctcgttattccgggaacctctttttctgtttggatataccgcgctctgaccttcctggttatatcctgtccgtgtgcgcttgtcatttcagtgcctatgagttttttcggcgggattggagccgcttccctgagcggcgttctggttaagggaggcaattatcttgaagcgctggcacagacggaaaccatagtttttgacaagacaggaaccctgactaaaggtatatttaaggtacagtccattgaaccaaaagggatttccaaagaagaactgctgcgtttgacagcttatgcggaaagctattccagccaccccatttctctttctttaaaagcggcttatgggaaaaagattgacagcagtcttgttacagaggttgaagagattgccggacacggtgtcacggctgttgtggacaatcacaaaatcgccgtcggcagcaataaaatggttctccggtacggtctgcccccggcagacaccggtgatgcggcgggcaccattgtccatgtgatagtagacggagaataccgcggctttatcgttatcgcggatgaaatcaaggaggacgcattcaacgctgtcgaggctctcagaaatttacaggtgaaggaaaccgtaatgcttacgggggacaccgatgccatcggcaggtcggtagcagcccggcttaaacttgacaaggtttacacggagcttcttcccggcgacaaagtggagaaggtagaggcaatgatgcaaaacaaatcagccaaaggaaagctggttttcgtaggtgacgggattaatgatgcgcctgtgctggcgcgcgccgaccttggtattgccatgggcggcctggggtcagatgccgccattgaagccgcggatattgttatcatgacggatgaaccatccaaaatagctacagccataaaaatatcaaaaaaaacgctgacaattgtccgccagaatattatactgtctctggcagtaaaatttggcgtcctgattttaggagccgccggattagccactatgtgggccgcagtgtttgccgatgtaggagtgtctgtaattgctgttctgaatgctgcacgcattctcagcaagaaacaatatatgtgagtaaattgtaataacaggaggaggttaccatggaaatgaaagacagcggctgtcatattgtgaatgaaaaattggtggaggaagctaaagcaggtatatccaacagggctgaattagattacctttcagagctttttaaactattaagcgaccctacccgtatgaaactggttttggccttatcctgcggggagatgtgtgtctgcgatttgggcgcagctcttggcatgacaaagtctgcaatttcacatcagttgaaaaccatgaagcagtgcagtgtggttaagtcacgcagggaagggaaaaatgttttttacagtcttcacgaccagcatatgacagatattatagcccttgcggcatgccatgccggccatgtccgaccggtttcagaggaaggctgatgtgattcatattcccggaaaagaaaacccggctaaggggcatatgcttataagcagatgcttcttagccggattttcaatatcgggcggcgtctccggttttattccttatacggcgtaatatcatggcaggagagcagacaggcgtcctgcgactcccagcggatataggaggcatctgccatggaccagaccttgaggacaggattgtaaacttccattgtctggttaatgttaatccggatatcgcgcacagggcagattctgcagggagtattcctgtcaaagaaagctttgtaacacggcattcccagacgggccgacggagcaatggcgtaggtcttggcattgatatatttcagcgcataggtgtcgggatcgattacataaatccaggaattctggttgtccagcaccatttggagattttcggccatggccaccgcgcggttctgtgcccgcattttcagcaggaaggtggataatagctctgaaataaaaatcagcgcatcaatctgagcctgtgtccagattcgtttgtctttacagtcgtcaaaccccacataaccggtaaatctgccgtcattgcgtatcgcacactgcagcagggaatggattccctgtttatgaaacatattgtacagtttgggcggaagcgtggcgacatcagggcagaaaaagacgccgttctcgttaaagagatcgcagtaacggcagtttccgtccatgaatttactgtagtctacattctgtaaattagcaatttcagatttaattcccttattacaccattcaaaggtattattgcagaaggtgccgtaattcgtgtcctcgataatatagacacggctgacattacatttttgccctaccatctccaggatggaattgatggccgcctcctgatttctggcctcataaagcacttgaaatgcctgttggatgatgctgtatgttaccaggttcagtgagtcgtcagactcaattcgggtgccggccgccggaagctgatctgaattccggataaatccgccggacataacggtcctgtcgtacagtgcgtattgatccttgccctgctgtttggcatggtagagcgcctgatcgcatgcctggaaaagtgtctggtaatcggagccgtcgtcagggcagcaggagatacctatgctgcatgacaaatggtaatcctgcaattcatccttcagtacattgtggaacgcgtcaacgactctctgggcgcgtgcgtgcaaaacctggtcatcggcaaagctgcacatatataccaggaattcatcaccgccgatcctgactatgacgtccccggtacggaacaaacgctggagctgtgaggaaatttcagtcagcacggcatcaccgaacatgtgaccgtaggaatcattaatctgtttgaaattatcgagatcaataatcatcattgacgcctgctccgagcctccccgttcctccagaagcttctggattttatggcgtcccgtacttttattatacagcccggtgagggcatcgcgttccgcttttgcggtcagttcctgggttttccgcttctcggcgtcaatatccagtataaccccgacagctttgattggatttctgttccggtcaaactgtgtggtggcacgtacccggcaccagacataatgaccggctgaatttgctatcctgatttcaagctcacggtacggaaccccatttcgtatactctccatcagggctaagaaggatggtacatcttctggaaaaagatgggaggcattcggaatccggctaaggctgccttcggaatccggcttatacccaaacttcttctcccagttggaggaatatgaaatcatatcgcttcctatatcccattcaaaaataatatcatttgtctgatccagaatgatctggtggcgttccattgtcagcctcaaatcctcctgggcctgctttacctgggtcatatctgtgagaacgcaattgatgtactccttgccgtccccggaaacggacaactggcatttatcgagaatccagattatgcgtccgtccctggcaagtatcctgtattccagttcaatggggattccaagcagaagtttctcgtggaaccgggcaattacctcggccctgtcgtccgggtgtattatattgaggtaatgaccctgcagctcatcatttaaatcggtacggctgtaacctgaaaggttgaaaaacccctgattggcatcaagaatagtaaaccagcggtcatttacacattgcaggatgcccaccatcaggttctgtatttccgttattcccgaggaacgttcggactgtgcggcctgaattggcggactttcgagccttttccatacgatgagaatacggtgggaatgcggtgcctgaatattgatacgcagagtcacagcttcataccagagataatcaccggtggccctgtggagaacacggtatttgagcgtgtgcttcagaaggccgttttcaacgaaatcatggatataattatcactggaaccggccacgatgccctggtccccggtatgtaccgatttttcggtgaaatttttaagggcttctttataattgccgccggagcgcagcggttcaaaatcttcgctggctatataaacaagatggtagatacctgtgcttaaatccacttccattacggtggaatcagcgcagcgcagcatagcggcatatttcatctggccatattgctgtgtatcctgttcttccgtctgtctgaattgtggcagcgcaggcgcttttcttaagtcggcttttggggaatgtccgtcggcatagctgtgggtcagacggacaaattcttcgcgggagcttttaaagcattccagcagtttgggtgaaaacacaccgcattctccgttcagaatcatcgtgtacgctttagccggtgaaaaagcctttttgtatacgcggtcggtggtaagtgcatcatatgcgtcggcgattcccactgcctgcgcacagatggggatactgtctcccttcagcccgtccggataccccttaccgtcccagcgttcgtggtgataccggcaaatccggtaggcatagcgcagatactctttatcatccatccgatcaaggcccgaaagaatttcacagcccttttccgaatgggttttcataattgaaaattcttcggcggtgagcggccccggtttatttaaaatagcatcgggaatcgatattttaccaatgtcatgcagggcggatgcgcttgcaataatattaatggtgcgttcgcttaaatcatattccggataactgtgcatgatattttcaagcaatatctttgtgaacatacggattctcaggatatgctggccggattccacgctcctgtgttcaacgacggaggaaagggcgtccatcagtacatcccgggactcgcgcagctttacggactggagctccaccagctcctccaaatgctctctgtgcagattcagttcaatggcattctgcactcttcttttaaccacatgcggttcgaagggcttcataacaatatcggaagcgccgagatcaaaagcccggacctcactctcgatggtatcttctgaggtgatgataataaccgggatgtttttaagcagcctggtccggttcatatccgacataacttcataaccgtttttcaccggcatgataatatccagcagcagggcggcgatggagtctttatactgattgagcagaagcagggcctgttcgccgttttccgcctcaagaatattataattattttcaaataaggcacgaagaatagcgcggtttacttctacatcgtccactactaacagggtattacggttcatatgaagtcactcctctttagtttcgccgccgtttaattaccttcagacgggtaaattcctcacggtctttttcttccagggaatttgtgatatcccggaccaggccgctgtaggatggaattgtaatgtttttcagtgcattggcccgtttctgggtctttttgatactggaagcaaggcggtacgcggaattctccaccatagacaggcggatggtcagctctttaacccggtcgaacgcggcccgggcctgatccagagattctttagtgctgtaaaaagcgtaagtgggaacctcctcctgctttttatggaagcgcaccagaggtatctccgttcccataatgctccgggctttgatttcaatcgaatcctccaccgggatcgattcaccggcctcctggacatagctgatgcccagctcgatatttgccttctggagcgcccgataggcggtctggaaggtgacatcgatttccgactggatgtctttggcctgatcgataagagccatcagttcacggatcaggatatttcgttttttatccatcagctcgtaaccctggctggccagggccagggagtttttcgccagtatcagattcccttttgtaggaaaagtatttggattcatttagattcatcccctcctccgggcggtcgttcttctgttttaatcggcggccggtttataatactgatccagcacctttgtgtctatacgatccagctctgtcctgggcagcatgccaagaagctcccagccgatatctaaggtcttaaggatactgcggttctcgtggggatcctggccgatgaaacgtgtctcaaattcttttccgaatttcagatataatttatctatcggtgacaattcatcctcgccgattaccgacgccagcgctctggcatcgccgactttggcgtagcaggaaaaaagctggtttgccacatcctgatggtcggctctggtaaaaccgtcgccaatgccgtccttcatcagtctagaaagcgatggaaggacacttaccgggggataaatggactggccctgcaggccccggtctaatacgatctggccctcggtgatatatccggtcagatcgggaatcggatgcgtgatatcgtcgttcggcatcgtcagaatcggaatctgggtcacggacccgtttatgccggctacgattccggcgcgttcatagatggcggccaattcactgtacaggtatcccgggtaaccttttctggaaggaatctcgcccttggaggaggagacctcacgcatggcctccgcaaaggaagtcatatcggtcaggataaccaaaatgtgcatatgcttttcaaacgccagatactctgcagttgtcagtgcaatcttcggagtaatgagacgctccataacaggatcatttgccaggttgatgaaggtgacaacgtgatcggaaacaccgctctcctcgaatgtccggcggaaataatccccgacctcgtattttacacccattgccgcaaatacaatggcaaacttttcggaagaatcatctcccagggatgcctgctgtacgatctgggcagcaagctgatcgtggggaagtccgttgccggagaaaatcggcagtttctgtccgcggatcagagtagtcagtccgtcgatagccgagataccggtccgtatatagtttctgggatattcccgtgaaactggattcaacggttttccgttcacgtccagccggacgtttccgggtaccggacccagaccgtcgataggctggccgataccgttgaaggtccgcccgagcatctcctcggagacaacgatctccatcggatgtccggtcagcctggtgtgggtattgcgaagcgccatattctcggtcccctcaaagacctggataatggccttttcaccgtaaagttcgattatctttcccagcttgcgttcctggccgccgacgttcatttccacgatctcatcgtaggcggcattctcgacgccgtccagtaccaccagagggccgttaatggaactgagtcccaaatattcaattgccatgatataagtccctccttaagcgttccgttccacgacaccgtcatagaaccggtcaacagcatcccggtattcatcgaagagctcggggcggttattgggaacgtcgtatttgatagatataattttctcaaaaatatcgtcctgttttaaaacggacatcggcatgcccatcccaatcagtgcgcggcagcgtttatagagatacaggataatttccatcatcttaaactgctttttcatcggaacacaggtgtcctcggcatgaaaggcattctgctgtaggaagcccaggcggattaccttggcgatttccaggaccagcttctgatcgtcgggcagaacgtcgctgcctatcagcttgacaatctccatcagtccattttcctgtgtcagtatatagacaagctggttccggtagtcgatgaagcgcttatccacattttccgtataccagggcgccaaatcggtcagatattcagaatagctggtcagccactggatagccgggaaatgtctggcataggccaggttcttatcaagcccccagaagcagcggacaaaacgcttggtattctgtgtcaccggctcggagaaatcgcctccctgcggcgagacggcgccgataatggaaacggaaccttccgtaccgtttaagttctgcatcattccggctctctcatagaaagcggacagccgggatgccagataagccgggaaaccttcttcggcaggcatctcctccagacgcccggaaagctctctcagcgcctcggcccagcgtgacgtggaatcagccatgatagcgacgtgataacccatatcacggtagtattccgccagggtaagaccggaatagagactggcctcacgcgctgcaaccggcatgttggaggtattggctatcagcgtagtgcggtccattaagggattaccggaacgcggatcggtcagctcctggaactcttccagaacctgggtcatctcattgccgcgctctccgcagccgatatagataataatgtcggcatcagaccattttgcgatctgatgctgggtcatggttttacctgtgccgaagccgccggggatacaggcggtgccgccttttgccaggggaaacagggtatccaggatacgctgtcctgtaatgagcggccgggatgccggatagcgtttgctgacggggcgcgggatgcggataggccatttctgtgccatcgtaagcttgatttccgagccgtccggctgtaatagtgtgatgagcggatcgtggatcgtatattttccgtctgccgcggcatcgagaacggttccctcaattccggggggaaccatgggcttgtggacgatggctcttgtctcgggcacttcggcaaagatagaaccctgatacagcacatctccttttttaacggtaatatgagtgtcccacaatttactgccgtccagtgactcgacacttacgccgcggtcaatataggcgccgcccgtttttttgatttcagataggggcctttcaattccgtcaaatatattggtaagaatgccgggggccagtatgaccgatacgggcgagccgcttcccgtgacggattccccgggctttaagccggaagtctcctcataaacctcaatcgttgtccgctcgcttgtaaggccgattacttcccccaccaggttctccgtgccgacatagacgagttcattcatcttaaagcccggatcgcccttcaggtagacaatgggaccgttgataccataaataatgcctgttcgctccatcttatctgcctcctatccggaactggaatttatcagagatttccgccagttttgttttaaatgaattatcaatcagaatatttttcgacggaatgacggcctgtataccgcccagaaatgtagtgtcgctgagctttatctctgcgcccgtatgcaatgcgatacggtttaacttatcctcgtcggatggatccagataaacggtcatcggagcgtcctgggcaaattccagcgcttttttaacctccgattccagaaaccgctgatagtcggctgaatccatgaaaagggcaagccggttcctcagctcgctgatcagcatggttttcagctcttcctgcttctggctgtattcccgcttaatattgatctgttctatcgataactgcttgttgatttcgtgttcaattttttccacctctgcgtccacctgcatgtcggattgacgcctggcatcccttttatgctcttccaggatagaacgcagggaggccgtatagtcggccagcattttattgctgcgctcggtagcatccccatagcagagggattcgaaatgttccagtttttcttcaatggtcaagttatgttcacctgctttccagtactgcttttcagcttttacagtggaatttctgttatagcttgaggccgattgcctcgttcacataggcggtgataaagtccggcttgcggccggtgccgtgacggtcgggaatttccacaaaaagaggaaaattgtgttccagtctgacacggttgatgagatccggaaagtcgcgcccgaatttttcggtcagcagaacaatacctatctctttatcggcgaggactttatcgagagcctcttttacttcctgcatttcatggacaacaacgccctcgacgcctgccaggcgcattccggtgagcgtgtcaatgttgtcgcttatcaggtacatcttcattataacttaccaaggatcatgaaggagatgatcagtccgtaaaggcagacaccttcggcaagtccggcgaagatgagcgattttccgaaaatagtggagtcctcgctgatggctcccaaagctgccgaagcagcggcggaaacagcgatacctcctccgatgccggaaagtccggttgagagggcggcagcaatgtatcccataccggctgccgagtttactgcagattccgcagcctcacctgcggcataggcctggcctgagaacatgaggacggatgcggttatcagcgtgccgaaaaagagcagtgcgttgacgcccagggcagttttatatctgcccctggtcttttcgccggcggcgaaagcgccgaagggaacggcgatactcaaaataagtgctgcagctaatacgattttaacggttaatgacataatagtaatcctccatatctttattcacgtattttatataaagttgtgtcatgcctttccatagggcttgaactcacgtccgctgcctttatagaaacggctgaatatttcataatattccagtctcagaacctggatcccgacaatcagtccctccattgcacagacaaacaggttgccgatgatgacaacagcccagttgagggaacctgattctgcgcctgccagcatcattacgacttccatcatggctgcatggctgacggcgaaagctcccacacggacaaaggacagggtgttggagaaatagctgagcagcatctcaaacatctcgaaaaagccctgtacaaagaacatgacccgggaatcggaatgctttccggcctgtttcttgaccagtgaagcaagcggttccttcagaaagataatgacaagcgggatgccgaacatcacggcaagcacccaggctgcagggagcgttttccccatcatgaagagaacaacaacagccagtacgcttccgtaaaagacgaggccggccagtccattggcatcaaaccaggatttctcagggtcatggaaacggacggaattgacgatgtttaaaatcattgtcagaacgataattcccattcccagcgcaactgccacaataaatacggtgttcagcttcccgataaacggcagattcatcatctgggccgcaggccgcagccataggggatggattacatcttcaaagccgaagacactgccgaacaggaaaccgaatacggctgagaaaaatccgcagcaggagataaccgcagccagatccatctttttaacccggtaaagaaggtagcctcccaataagagcagcagcccctggcccacatctccaaacatgaagccgaaaaggaaggagtaggtaatgccaatcaggatggtcggatcaaactctccataggcgggcaggccgtacattttaatgaacatctcaaacggccggaacagctttggatttctcagctttgtcggaggcggtgtcagcagattattatgatcatcttccacaatacagaacgtcttgtcgtccgtctcaagctctttcttaaagtttgcggcatctgtctccgtcatccacccgcagagaatgtaaaaggtgttaacatcatggtttgtgcaggcggccagcttcctcacattaaaattggtgttataggaattcagcttttcgtaggcagccaggatgtcccggcggttttcttccagaatacggctgatttccgaattcgttgactccagtgcagcctcggctttcttaatctgctgttccagtgcatcgatcgcctccccgggagtgccgttatactcatccggcacaatgaaacgttcaaaatgaagggaggtatagattgcatcaattcgttttgatatcacggccggcacaaagtaaacgatggaaacgtaatgctcatcctcatgacatttgtagaggattgtatctaatgattcgtagaccactttttcaaatttggcgtaatactcccgcgggatccggccgaagcggaaccggatatgctggaaatgcaggattgaccggatgtcataatccagctccctgaatgggacaatcttgttgtaggaagtcctgagggtatccagttcctcttccagttttcccttgctgtcacggtaatctgccagttccttgtctacacgctgtacggtttcagaggcctcttcgattgaaatatccccgccggccaaaatccgtatggacttattccttccggcggatgtatctttgtcccgggatgtctcactggcattgaaagaattggccaggcgggcagcccgggtaaataattctttatagggattaatctcaatgtaagggcgaagatctttgacagtttttaattctgataaagcattttcaatctgaatttcgtatttgctgagatacagattgacaacccggtctatatcctctttgggaccggttatgcttagaaatttcattttctctatcacggcgtgttcccccctgactcttctttttctataatatccagtatttcaccggcgcccagatgataacgaatcccctcgattacagtaataatctttctcaactcctcttctttaaaatacagatacgagtagagagtggctatcgaatatggatttcttctggcagcggtgcggtgaatgtgcgccagtatcacgccatacagaatttccaggtcaggcttctcttcaagagacgccgcctttgtctgtgcgccataccaggtatctgagagaacggaaaaaaactcatccatgctttccgcggcaatcagatgctccagctggctgcttcgcagccggtaacggattggtatcagaagctttttaactgcttctccggaaacggtgtagtaccgtttggttctgtaaatccactgcaggttgagcagatccagctttgtaccaaagccctgcaggattgcgtcctgttcccgtctgggtatttttttctttattgctctccatgttacattgaaatagtataaatcaagcgccatctcatagtcgaaatggcctccgtcgccggaatcgcggatacctgcgagcagcgggtaataaatagtgccctccaggctttctatgaattcatccgtcgttgccgcggtgccgatggcaacaaggttgagcttcgaatgagagcggaaaaaatcttcgtatctggacagccccacgggaaccggctgatgggccgccgcattcctaaggcagctttttaatatatcgatctcaaagtgcataaaatacagtttgaaaaactgacgctgttttatcccggcaaaacggtacagtctggcataatccctgtacagggcgccggccagcagacgttcgattgtaccacggtgaagatcttcgctgtccatatccgggaatatatcggagtaggtgggaatggagcgcaaaaaatccacagcttcaggtacactttccagcgcagccatagcgcggtactgttctttggtaagaagctgccccttcattgcgcggacctttgccgtaagtccgctgtaggccagaagtcctctcataagaatcacgctcctgtcatttctttaaacagctgttccacataatttttgctctgacacttataatggttttcaagcttttccagcatatgatcggcgcggctttgctgacaggccagctttttcttcatctcagcctccattgaggtccgcacctcgtcaatgcgtgcggaagtttccgcctcaagttcccggtcaaagctttctgtttcccggcggatctgctctgcgatatcctttttccgggctgccgcgtcatccattattttaacagctttattttcaattagtgatatttttccaataatccgatccatgtaggttacctcctgcggtgattgatgaagttcatgccagagcgtgtcagaaaatctattcccgctgtctgaaccgatctttacaatagtatacgcataacggtgaaaagtacactttcagaaacagtacagaaagcatgaactgtttccatttaacgatagcctgcacgctccgcgcacagatcaccgccttcaattaaaagaaaccatagcagaattgggatattccgctatggtttttgggcagttataaataaagcgatttcagccaatggaatccgaacttctgtcattcaattattcggtgacaggtgtgaggtattcctttgcaacgtaggcatcctggccgttgtatctgataatacaccatctgtcatcatgatcacgcacatattcaacttctgcaccccgggccagctgtacgacaatgcgtccgtctgttgcaggggttgcccgtacgttcagtgtatccgcattaactttgtatttaacagttgcagcttctgtagtcggctcctctgccggactttcactttctgtcggaaccggttcagtcatttctgttgagacggccggtgcagtagtttccgggactttctcttttcccgggtgaatcatcttgatgataaagattaatactacaataattgcgattaatagtaaaggttttataatacttcccgcgtcgaaggaaggaccggaagactgtactctgcgccttctgctggaacttccccctgaggaggagcgccggcccggtgattcatccgtcctgcgccgcgctgatgcagccggtgcaggtttacgccgccgttcgttgtagtcgttggcaaatgtgtaaacctcctgtgagagaagatgatgggcctgattggcattgtaggcgctgttgtcttcttcatgaatagccttattgcctatggtcctgatcttgtgataatgttcgcaggtggtcttgctgatgattccatcatcatatagcccgtcaatcatatcaatcaggttgccttccataacgcctgatttctcacaaaggcacttcaccataaattccagggtctggcgtgccttaatcatagccatgttgtactttttctgtccgattagacgttctgtatctctaactccgctttgaattttctcccagctgtttgtgcccggattgtctgtattgttcataggctgtctcctttgtatcagtgttactcaaaccttaattatccctattataatatataggaaaattttatgcacctatattttaaaataaatttataaaattaggaaaaatgtaatatatatcttagaattgccgcagctatttgagaatttacagattaacttgcataaaaatcgttgaaatggtaagatagaaagataaaataaatggaaaaaccatgaaaaataaaggtaaatgtaaaaccaggaggacgcggtatgagactacgccatataccgggcgcagagcagatgatagaggacagcccctacgtaattcagaatcccgaagagcggaagggaaagtggcatgaggttttcggaaatcacaatccgatacgcatagaagtaggtatggggaagggcaggtttatcatggaactggccaaagccaaccctgaaataaattatatcggcatagagcggtattcgaccgtactgctgaaggcgatacagaagagagaacagcttgcaattacgaatatctgctttatgtgtatagatgcaaagaatatggccgatatttttgatatgggggaggttgacagaatttatctgaatttctcggatccatggcccaaggacaggcatgccaagagaaggctgacatcacctcagtttatggaggtatatgataaaatcctgaagaaagacggcaccgtggaatttaagacagacaacaggggactttttgattattccctggaatcggtaccggaggcaggatggaatattttagaatatacatttgaccttcatcacagtgaaatggcggaggggaatgtaatgacggagtatgagacaaagtttgcggcagagggaaagccgatctgcaaacttgtggccgccagagagattgcggcagacggaaaataaaaagccgcatggcccgtcgggtatctgtacatgtgcgataagcatataatgtggaaaacagcagacagcaggtgtgcagatatgagcatgaaagccagaattacccgtgaattgtcgaaagcgacaagtgataaggcggaactaaacaaaaccgttctgaaatggaaaaagcattttgacgaagcgggaaaggtgatcagtgctgacagaaaaaagaagaagtaggaggagttgcgaatggagaagagatttacgagcgagaattttgaaacggaagttttgaaatcagatgtaccggtactggtagatttttatgccgactggtgcggtccgtgcaaacgaatggcacccatcgtagaacagctggcttccgagtatgaaggtaagattacggtcggaaaggtaaatatagacgacagtacggatcttgccattaaatacggcgttatgtcaataccgactctgatcgtattccgaagaggagaagtgttcagaaaagaagtgggagtacagacgaaggcgacggtggcgaaggcgatcaaccaggccatttaataattaattaacttgaagcgtgaatgcaggggggatccggcttttgccggagccctcttttacgaataaaaccgggatagttttaataaaatatatactttggatatattttttacaaaactttaaaaaaaaggttgacaattggagatgattgagataaaataatccatgcgtcacgaaaaatgacgaaagaaaatattctcagcgcctttagctcagttggtagagcagtagactcttaatctatttgtccagggttcgagtccctgaaggcgcactgataagtactgattttgcagactgagagctgtggggtcggtgcttttttttacattaagattggacctggcagaattgagcagctacaaaagcattctggtgatatgtcaagaactttttgaagaagattttgatatgtttttcagaaaaaagggtaactttaacagaccttcggtatattttacgtataaccgaatgtcagttcgactcaatattatattcggtgtccagcttttcgccggtgtacagttggtttttgaccagcaatccaaaaacgagtcgtactaatttacgagatgtaagcgcgagtgctcttttgtgctgatgtttggttacctcagcatattttctggcatagaaatcagcatattcagggatgtgcttcctgacgctgtttgccgcttcgccaagatagcagcgaagatagggatttccggctttcgacattttgttgtcctcagaagtgaaatctccggaatcacccttaggccagtaaaggccggcatatttggcaagggcatcggatgaatggaacacggttatatcgcctatttctgatagaattccggatgcccatatcggacctattccaggtatggattgaaggatgagcagggcgttagggttcattccgttgatgcatttctcaatcgcctgctcgatcagcttgatttctttctgataggcgtggatgcagttaaacgagcttgccagtgatatgctcagtggttcatacatgcacttgtctaaccggtaggaatccctggctgccttgcgcaggagttccgaagtttttgataggtcagagatgcggttcctgctcttccccgcaaggaaggtaagcagctcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtacggcctaccctgccaaagtctgcgatgagatatgcatctgtgggatcggtcttttccattccgatataggactttcggtaattcgaagtggcctttgggtttacacagaatacgtaaggcctgtagggcatgagaacctcgctggccgacaggaagtttgaaatatgcacgctgtatacagaagtagattccagcacgataagaaccgtatccaggtttttatgcttctgcatgcattcggcaatcatatttacaagctgatcggcgcctggctggttattgccaaacgacgatgagatgtatttgttttcctcaaagtccatggcatagacggcattggtctttgagcttacatcaatacctacaaacaaggtggacatatagttgagctttaacatgatatcacctccattccgatggggatttgtgaagcctgaagcaaaaggtttatcctgtgccgcatacggtgaccgaaccctcgcgcaatgagcatgcacccagtcagccttttttgctggggctaacggctggggatgaaaattctgtgtcagcggaatgtgccgtatgtgccaggctgaatgctttcaaagcagtctcggacgaagccggctgaaaggaggagaagcagtgccttcggacatcagactctacctgatatcataccacaggatctacctatattgaaatgtaactatcaactgtatagatgggaatcgggatgaggggagtacctcttagatatccttaccatttatacccaaaaaagaataagtctgtaagcggtttttcttgcttacaaacttattatacgaggagatgtggtatgaaaattggggagttggcgaagcttacgggagtgtcaaaagacagtatccgcttttatgtggaaaatggccttttatttcctgaccggcagggacctcagatggatttttcagacagagagcaggaggatcttttttatatcaaacggttaaggaaggcaaggtttagtataaaagaaataaaatttcttcaatcccttaagcataccagcaatatgctggaaccggatatactggaagaatattgtgatatgcttaatcagaaacaagcatcattggaagaggaaattgaagaactatgtgaagctaaaaaactgcttatgcaggaaaaaatcaatctgcagtcaaccagaaacaatgcaattcatcagttaggtgtaccactgcgtgcattaaaatatattgtctgtccaaattgtggggctcaaatggagatggaaaacgccagaattgtaaagggagggtatattttagaaggcgatatgcattgtgtctgcggccatcagatttccgtcgaggacggcattctgatgaccggaaaccgatatacgaaaaattgggatcatccggattaccgacatggaggaattgtccaaaatgtaggagataatttttacaattgttttcgcaaatgttatgattttattatgagtaatattgaaggagattttctggagggcaaagttgtgatggaggctcaggtgaacgggtattttttcttgtataagcattttaacaggctgcctactgactgcctctacatcatagttgacaagtttccggaaacattgcgtacgtacaaaaaattactggaacagctaaatcttccgcttgaaattttatttatagcggataattcagttaattatcctttgcgggaaaggtgcgtggatttgctcatcagttttttcggcgataatgaatatctgttataccatcatggtttttttattcaagatgccggaagatttatgaaaaatgaaaatctggtactgggtgcaacaatgagtttccggcagaaatctaaatcacgggagcttatgccgatgaaatatccggaatcatccccaaaaactcataatatcaacgagttgaaaaaggcttatgagacacaatcctacgattttatatgtcaggaggttgggactatgacgaaaacgtgcaacgaatatgcgtatgaatgccatcaggatggtgagcctcttgatatgtactatttcaaggctgaacgaaagtaagaaaatagagagggtgctcctctctattcttttacgcgaatattttcattctcactttgcagagccagaactgtattgatatgcagggcagtgccatagatcaaagcagccggagacaccttaaaagaaggattgtgtaaatctgcataggtggtgctttctggctctgtgcagccgagaaataggaatgctcccggcacttctctaaaatacagtcctacgtcttctccacctgttagtggttccggtgtgtcattaacgtgttcggcccccagtaattcctttgctgctgaagagattatgagagcaacggtttcatcgttcaccgtaggaggataaccgacttctctttcgtagactgcctgacatcggtgtgctgcggctatccgctctgcaatttctcccagacggaagctgactgtctctcttgctatatcgctgtaagtacggaaggtcccgctcagtataacttctccgggagtggcattccacacagaggaaacagtattgacagtgccgacagtaatcaccacaggatcaaatgggctgatttctctgggtacgatggtttgtatcgcggatagaagttctgccagcgggggaatgacatctatagcgtggtgaggagcgccgccatggccgcctttcccttttattgtgatacgaaaaaggtcagttgccgccatggcttctttccggaatattttcaaattgcctgtcggcatactgggatctacatggattcccatacaataatcaacattcttcagataaccctcttggataatataataggcacccccgcaaacatcccccaggggtgcggcagagggatcgatatcctcttcggcaggctggaaaataagccggagattgccacagagtttttcagggtgttgagaaaaatattttgctgcacctaaaagcatggcgacatgtgcatcatgtccgcatgcgtgcattttacctggatgttcggaggagtaggggagccctgtactctctgtaataggaagagcatccatgtctgcccgaagagctatggtttttcccgcatgcactccatataccgtaccaattactcctgtgcgtgcgacaccggttatggtttcgatattccactctttaagtttgttagcaataagagcggcggtcttcacttcattaagtcccagttccggtatgcgatgcagttctttgtaaagattaatgacttcatcttctaattcatttaattcactgatgggaatcatatttttctcctcctataataggttttgtggtagttagatacctaacagccagttaggactaaccttttcattgtttaagttgtagaatgaaatggcattggtgtgacgatgtcctccttggaccctggtgtccgttaaagagcccgtcaaccggccattccgttcgcaaccgttcgtttcatgcaggttggactgtcttgtacatgtccgtatgatacccaggagacagaatcagcaatggataaccgctggtaccatgtaaatctatctgattggagatcacttattatgtttaatgctgttggtattgatgtctctaaaggcaaaagcaccgtttcagtcctgcagcctggcggtactgtcgttaaaaagccttttaatgttgtacactcttccagttccctgaacgaactttccaggtttatcctgcaccttgacggacagactagggtggtcatggaatgcaccggtcgctatcatgaacccatcctccatgccctccacgatgccggtatctttgtcagtgctgttaatccacacctgatcaagaacttcggcagcaactccatccgcaaagtcaagtctgatcctgccgattccaggaaaatcgcccgttatgctcttgacaactgggcttctttgaggcaatattcagacatggatactactcgcacacaacttaaaacccttaattcacagatggacttttttacaaagcagaaggtcgctgcccggacaaacctcatctcacttatggacatgacctatccgggtgtgaactccctcttttccagccctgcacgtgatgatggcagcgaaaaatggcttgattatgcggaatccttctggcatgtggactgtgttcgtaaaatcggtctgaaagcatttaccaagcgttatcaggcgttctgcaaacgcaacggatacaactttcaacccggtaagccagaagaactatacctggcctccaaagaacttgttgccgtttacccaaaggataaggtctataaagaccttattatgactgggattgaacagcttaagtcaaccacacagcatgtggaacatatccggcatgaaatggacgcgcttgcttcgactcttccggaatatgaaaccgtgctctccatgcgcggcgtaggcaaaacgcttggcccgcagcttatggctgaaatcggtgatatcacaaactatacccaccgcgaggcactgactgcctttgccggagtggatccgggagtaaatgaatctggttccttccgttccaaaagtaatccggcatcaaaatgcggatcgtcacggctgcgaaaaacgttgttcctgattatgacgtcgctgcttcagacctctctcgcggatgaccgcgtttatcagtttctcgaccgaaagcggtctgaggggaagccgtatcttgtctatatgacagccggtgccaacaagtttctacggatttattacggcaaagtaaaagcatgtatagctgctcaaagcaaatctgagtaatcacatatcttttttcgagaccggcagcgatggcggtcttattgtagtgccataatctatctgcataattttctttgaaaaaccttcagtttagacttgactttttattagcaggctctttatattattaatgttttaaaatggaccatatccggtaattgctgcataggatataaaaattatagctaccagcaaaatttttaaaattaatggacagtaaaatctcaaccacttatcataaggcaccttgccaaaggctaaaccaataaagagcaggcctaaagtaggggtgaccagattggtgattccgtcccccaactgatatgccagtacggccgactgtgaagtgagccccaggagttctccaacgggaaaaagtatcggcataatagcaactgcctttccggagccggaggggatcaaaatattaattagactaattacaagcagcatccctatagcggaagcccaaacaggaagggaacttaagggcgtagaaatgctatagataattgtatccagaatattgcttttagttataatggattgtacgcctgccgcaacaccgataatcattgcgcctcccgaaatttcagctacacctttcaaaaaggtttcacagatagcattaattctcatacggctcagaattccggctacgataccgatgatgatgaaaacggcactcatttcattaagccaccagtcggttgtaatagccatataagtaaaataaaccatgccaccgattaatgtgcctaaaatacatctgtgacgccaggtgaatatttctttgttcatactgtcaatatcaaatgaaagctcagaaacatctacccccctcatcagacttttattgggatctttctgtattttttttgcgtaggatagaacgtgccaaagaccgattacgtttaatacgacaaatagcacaaggcgcagaccgagacctgaatacaagggaagtccggcgagtgcctggggaattcctacgttactttgatttgtaggaccggcaataaatcccatcatacagccaatcaatgcgacacccacgccaaccatggaatcataacctaaagctacagaaatggctatagctatagggaaaaatggaatggtggcttctccaaagcccataaatccgcccaagacggaaaaagattgaaaacaagaataccagaaccaaatcaccgcttttttgattgaggttggaaataactttggaaatgccaatatggagagcgccagattttgacactacctccatgccgccgccaatcattaaagtacagacaaccattccggctgctgatatgataccttccggaatggccagaaatatatcaaatatggtcgctggtgttttttctattagttgataggaaccgggtataacttccaggcgtcctgtagcaccttcaatacgttcaaactgaccagcaggaatcagataggttaatattgccattacagcaattataatgaagagcagtgcaaaagagtttggcatttgaaattcttttttttctttcatttttaacatttcctccttgatatatcatattatttgtctgcatttactctatttatttttacaggcatttttaaaagaacgaaataaattttgttgaattgcttccctatacatcatctcaggatgccattggacagccagaaagaagggatgatccggaagttcaatggcctccaatacatgatcctcagattcgccggccgccatgtagcagccggcaagctgtttgatggctgagtgatgataggaattaactggaagtgttttgcatccaaatatggattgaattttacttccttcctttaagttaactgtatgtactggctgatacatgggggattcgtctatagaatgccggttaaagccggctgcgcagagatcctgatacagtgttccaccagccgctacattcatggcctgcattccccggcagattccaagaaccggaattctagtgctgtttaataggctcgtgataatctgtatatcttgtttgtctctctgacttacaagcgcaccgcatttttctgtggtttcttctccgtaacagtcaggagaaatgtcattaccgcctgtaataatgacaccatctaaagtatcaagtaatccttccaccgtattaaagtgttcgcaaatcggaattataattgggatgccgccaatccgctccacaaaattaatgtaattgtcagccagaaactgccacttttgcaggggcacccccatatcagtgataattccaatttcatcattttcatcgtagttgcaagtaatacctataatcggttttcgtttcataagcctccctctcctaattattttatatatcttgttattcaatactttatcataagggaaaaagtctatgtcaatatgtaataatcaggttttaatgcaaaaagatggacctggtccatcttttagaaggggtaatgctgattctgtgcgcttggttccatatcacagcaattttaatatattttaatttccagtacgaatcgaagatgatataatgaccgcatagcgtgcattataccgcacagaaaccgtaaacagtttctgcgtttaccgcagtaatccgggctgatttccgtcggagactcgtgtgaacgcagggaacatggtataataaaccgatagggtgatgaaacggccttttttacataagtgaatacggatggatgtattcaggaaaggacttacatgaaaataaaaccaggtgacagccgtgaattgagcaaatcttcagagactgagactgaggtttcaacggggacaatcctgattgatcaggattatcatattatctactacaatgaatatgctaaaaaaattctgtctgcgggtgatgatgcaattgagcatcgctcggtcaggtattttcttggacagacgtttacacttccggaggaaccggacagcgaaaaatcgttttattatgaaatacagggacggcaaatccttgtcactgtaactagatggggaggcggggaggaaaaagacgtgcctgcctatctgatactgcttctgcttgagccaaagctggcacagaatgaattggaagagtatgcaaaaaaacaagtgctacaggatctgcaggagatcatagaggcatcctttgacggtattttagttacagatgcggcgggtaacgtggagctggttaaccagggatatgtgcataataccggcattacgcgaaaagagcttctgggaagaaatatactcaagctggtcaatcccgtatggatgaaacagtcggtagtgggtatggtacaggagaagaaggagaccgtatcgctcagacacatgaccaggaatggaaaatccattattgtgacgggtacccccatctttgatgaacagaaaaatataaaaaagattgttgtaaattcccgggatatatcagagctttatgccctcagtgaaaagctggagtcagcaaaaaagatggaagaaatctatatgcagcgactgaagctgcaggaggaacgaggggagaccccggatgacgtcgtcatcgtcaatccggaaatgcagcaggtcttccgtcttgcaaaaaaactggggaattttaatacaaacgttcttcttaccggggagtccggcgtaggaaaggacgaggtggctaaattcattcacaaaaacggtcttcgggcctccaaaccgtatgtcgcagtcaactgcggcgccgtaccggaaaacctgttggagtctgagttgtttggttatgagaacggcgcatttacgggtgccttgaaatgcggaaaaaagggattattcgaacaggcggagggaggcgtactatttttggatgaggtggctgaaattccgcaaagtctacaggttaagctgctgagggcgctggaaaaccgcgagattatgcgtctggggggaacaaagctgataccattgaatgtaagaattattgccgcgaccaatcaggatctgcctgccatggtgaaaaacgggagtttccgcgaagatctctactaccgtctcaatgtggtaaatatccgcatcccgtcacttcgggaacgaaaggatgagataccgcttttatgtctgaaattcgtccactattataacagacagtatggtgaaaacaaaaaaatgacttatccggttatcagggaatttgagaaatactcctggcccggcaatatacgggaacttaaaaatgtaattgagaacatgtttgtgctgtcggacggagaatatcttaatgtcagggatatcccctggattgggaggaaacagaagcttggtaatcaatatgaaggaagaactctggaggaggcggtggaagaggtagaaagggagcttctcagggaggcaaaagaaaagtttcatactacccgtcagattgcagaacatttaaaggtgaatcaatccaccgtggtccgtaagctcaaaaaatatcaattataaaatggatacaaccagcgttatcgataccattggctctaatcaggcagcgcagtaaattttgcgccgttcttattggagccaaatttatttatatgccgtccggcatctttatgcaaatatgcatcaaagatgcagaacggcatcatttttttgctttattcaggcataaaaactgctttataacgggttaaattataaaatcaacgcatttataaacgttaaaaattacaataaatcttaatttaaatattttttaatcagaaatagatactttcaggatagaaatgaattgtctggcacggaagttgcttttaataaatccaaaaagggaaaggagtttacggtatgacatcaaaagaaatgctgaatcagcttttagaccagcattatcaaaatgcaatagaaacgaagcggcagggaaagcttgtggcctgggcaacatccatatcaccgcaggagcttttagaaaccatggacatagctgtggtctatccggaaaatcatgcagcagcaatcggggcaagaaagtgtgcgcttgaactgctcgaacactcagaatccaatgggtactcgacagatatttgttcctacgcccgggtgaacctgggatatatggaggttctggaaagcccggccggcaatataccgcttccggatctgatcttctgctgcaataatatttgcaatactgtgttgaaatggtatgaaaatatagccaaagaactgaatattcccatgattttaattgatcttccgttcaaccatgagtatgaagtgacagaacaaaatgtccgttacatcagaggccagctctctgatgcaatcaaacagctggaaaagctgacagaaaggtccttcgattacgaaaaatttcatgaaattatgaagatttcttccgagacagccgggtggtggaaaaaagcttcgctgatggcccgggccaaaccgtctcctttaaacgggtttgacctctttaactatatggcggtgattgtctgcatgcgggggcgtaaagaggggctggagctttttaaactgtgggtcagagagctggaggaacgaaaagctgccggattggggccgtggaaggatcaggaggagaagattagaatcctttgggatggcatcgcctgctggccgtatctgtccgccacatataaaacacttaaaaagtatggcattaatctagtggcttccacctatccggactcatggacaattctgtatgaagcaggtgatttggacgggatggcgagggcatacagttctaattatgtcaaccggaacctggactacggagtagataatctgtcggctctggtgaaagagttttcagttgacggcctgatttttcattcaaaccgaagctgcaagctaatggatttcaggcagtacgaagtgatacgccgggtagtggagcggactaatgccacgtcggttatctttgatggagatcagaccgatccgagggcgttttcgcttgctcagtttgaaacgaggatacagtctctggctgagacagtggaggagaaaagaaaggcaggtgcgtgaaatggataagccccaacaggaaattggatttttgtgccgggcagccgatcatccgcgggaaaccgtcttaagagcgatggaaaagacagggaagagggcagtgggatgttttccgctccacacgccggatgagctggtggatgcagccggatttttgccggttggaatgtggggcggtccgggagagtcaccccggtcgggacaatatctccagccgttttgctgctccgtaatgagagcaaacatgtcccaggcgctggacggagtttatgatatgctgtcgggcgtgctgattcccacattctgtgacacactgaaatgtgttgccgagaactggaaggcaggaatccccaatattcctgttttccctatggtttatcctcagaatgttgggagcgccgctgctgctgcgtatctggaggatgagtttataagaataaaagagaagcttgagcagttggcgggccgaggtatcacggaggaatccctggtggagagctttgaccggtttgagagatgccgttcggtcatgagagaattcaccggtctggccgcatcccatccggatttgatcagtgcaaagacaagacataagatattgaaatcatattattttatggacaaaccggaatataccgaaattctgaatggtattaatgaggaactgaaaaagaggaaagggagccgggattcgaatccggtacgggttgtggtgaccgggctgatgctggagccggatgcgctgttaaatgtgctggatgccaaccggctctgtatagcagcggacgatttggcgcaggaatccagaattttccgtgtacagggaagcagagagggaactgtattgcagaggatggccaggaggtttttagaccagaggggagatccgtttctctgcgaacagggaaagtgcagggggaaacacctgattgaaatggtgcgccagactggggcagccggcgttttgattgtcatgatgaaattctgtgaaccggaggaatttgattttcctgtttacaggaaagagctggatcaggcgggaattccatacctctatatagaattggagcagtcgatgagtcaggcggaaagtattagtaccagaatggaaggatttgtggaggtattacgcaatacaaatgcatctttaggtaacggttcagacaggtctgcgcatttgctgcgctgaccgtgcgaaaatgtagtggaagcaagcatccggctcatcgcacagcgattttatcagccggatgccgtaacagttcatgctgtctgaactgttgcatcttccggcagatcaggggaggtttaaatgaagattaaaaatgtggccgtactcggatgcggcacaatggggaaccagattgccatacaaagcgctctgtgcggatatcgggttacaaattatgatttgaatcaggatatgattagaaaagcagagacatttacaagggactggttcacttccaggataaaaaaaggaaagatggacgaggaggaagcggtcaaagcgcaggggcgccttgtatttaccgatagcctggaaaaaacggctgcgggcacagatcttgtgatagaggctgttcctgatattctggccgttaaaagacaagttttgagcgagacagaccaatacacaccggagcataccatttacgcgagtaacagttcctatattgtaagctccctgtttgcagattcggttaaaagaccggaaaaggtggccaattttcattttttcaatccggcccttgtgatgcagcttgtggagattgtacgggggcctcatgtatcggatgagacggttgatacgctgatggaatttgccgcttccattaataaaacaccggttttggtgaaaaaagaaatctacggatttgtggtaaacaggatattcagcgcgatcactaaggaggcctgttatctgctggatcaggatgtagcatcggcggaggatatagatacggctgtaaaaaaaggtctgaaccacccgcttggccccctggagcttctggatatgacaggaattgatctcgaatatcacgtactgatggaacattaccggatgacgggtgagtttgccgataagccgtcggcagccattgtggagcattttgcaaaaggagaatacggcaggaaaaccgggaaaggtttttatcggtatgaagatggcagcagacgtttgtgaagggagggttattgtagatgggaagttttgtcaggcttgaggtaaaggaacggattgcgtatttgtcactcgagcgtcccaaggcgtataacgcgctgtcaagacaggcggtggatgaactggatgaagcgctagaggagattgcttcatgcgggagtatcagtgtattggtaatcaggagccggaaaaactttgcgtcaggagcggacatacgggaaatggcggatttaacgcaggcggaagcggaaaagttttcattcagccctacatttgacaaactggctgaaatcccgattcccacggtagcggcgatcgagggttacgccctgggcggaggactggagctggcactggcctgtgacttgcggattgccagtgaagatgcagtgcttggtttacctgaaattacacttggcattatgccgggagccggaggcacggtccgcctgccgaggattatcggggaggctaaagcaaaagaactgatttatatgggcgaaaaaatcactgccagggaagccggcaatattggtcttgtgaacagcgttgtaagtccggatagctttgaggaagctgtggaaactctggccgggaagttgagcgcccgttccggttccgccctgcgtgcggctaaaagatcaatcgatggcagcctgcaggagccggatcgcagaagatcgtcgggaaatgagcggcaaaattggtccgccctgtttggcacatatgatcaaaaggaggggatgcacgcatttatcgaaaagaggagaccggagtttgaagccggaaaaagtgaagggagctgaggaaatgagaagcgtagtaattacagcggcatgcaggacgcctataggtgcgttcggaggagcttttaagaatctgggagcactggatctgaccatacctgtgatgcaggaactgattaaaaggagccgtctggatgcagggcggattgatgatgtaatctggggatgcaactaccagaaaacatacagggagaataatctggcgagggtagctgcagtgaaagccggacttccggttacagtaccggggatcacggttcacagaaactgtacctcctcggtgtcatcggtacagttgggattttaccagatcctggccggagaagcagactttattctggccggaggcaccgaagtgatgagtaacgccccgcacacagtggaaggagtccgctgggagaaaaaactggggaattttgaaattcgggattccatgtgggattcgctcacgaatcttggcattgggccggccatgggaattacggcagaaaatcttgccgagcggtatcagataagccgaaaagagcaggatgagctggcgctgctcagccagcaaagagcgtgcagggcagtggatgaggggaaatttaaggaggagacggttccgattgaggtgaagagcaggaaaaaaacggtgctggtggaacgggatgagtatcccagaaaggatgcttccctagaggcactgtctaagctttccgcttccttcaaagaggatggaaccgtgacggccggcaacgcctccgggatgaatgatgcctcctccggcgtgattctggcgtcggaagaaaaggccagagaacttggccttcccattttggcccgtatcatctcaacggcaacggtgggggtcgagccggatataatgggaatcggtcctgtggacgctgtcaataaggcgcttaaaaaagcaggactgagtttggaagacatggagcgggtcgagattaacgaagcatttgccgcccagtatctggcctgtgaaaaggcattaaacctgaaccgtgaaattacgaatgtaaacggcagcggaatatcgctgggacatcctgtgggagccacaggcacacgtatcatcacatctatgatttatgagcttttgcgtgaacggaagcgttacgggcttgtggccatctgtgccgggggaggtatgggaacggcaatggttctcgaagcattgcaaaaagaagatcaggaggagcggtctcatgtataaattgagcgagcttaaacgccgttatcaggaaaagcttgtgacggcagaggaggcggtgcaaaacgtacgatcgggggatcgtgtgcattacgggctttttggggggatcgtaagggaactggatcatgcgcttgcgctgagggccggagagctttccgatgtcacagtctatgccaccatatggggaaacggatatattcccgctattatacaggcagatcctggggcagaacattttcattactgcaacactcatttcagtacgcttgacagaaaattaaataaagagggggtatgctggtttgtacccgtgcagttcagggaaaatccaaagctgtacgcggaaaatgtagacggcgggatcgatgtggcgatgttccagacggctcccatggatgcatacggaaattttaattttggtccgcagattgcggaatattggggaatcttagaaaaagcgaaaaccgtaatcgtggaagtaaatgagaagatgccgataaaccacggcatgcagaatgttattaacctgagtcagattgattatgttgtcgaaggaaaaggctatccgctgaattatttagaatcaaagccggcaacggaggaagaacttaaaattgcggaacacatcgttccccacatcaaaagcggaagcacgctgcagcttgggataggaggaattcccaatacgataggagccatgctggccgattccaaggtggatgatttaagcgtccatacggagatgtttgtggaagcatacctgaagctttacaaggcgggtaaaatatccggcagcaaaaacattgataaaggaaagatggtttatacctttgccagcggcagcaaggaattatttgactttatcgacaataacccgattacatgcgccgcgccggttgactatgtcaatgatataggagttatcggaagtatcaatcagatggtatctattaacagctgtctgcaggtagatctgtttggccaggtgaattccgagtcatccggctggcagcatatcggaggcacggggggacagcttgattatgtgctgggagcctttcagtcaaagggcgggcagagctttttatgtacgccgtcggtacggaccggaaaagacggaaggagagaatcgctgatcagggcgaggcttccggaggggagtatcgtgtcagtgccgagaagtgcggttcactatgtggtgacagagtatggggcagttaatctgaagggaaaaacgacttatgagagggcagagcttttgatatcaattgcccatccggatttccgggatgaactgagggaagaggcaaaacgtatgggtatctggagaaccagcagcagggttctggcataaaaacgttactgtattcaaatgataaatttaagggggtataagatatgacagtttacactgttttaacagattttgcattagcatcctttttaatactggttggacagctccttcgcgcaaaggtaccgcttatccagaaatattttattccatccagcctgatggccggttttctggggcttttcgctggcagggaatttttgaacattttgccgttctccgattctatggggtcttataccagtgtgctgatgattgtaatatttgcagcaatcggtattaacggatttaagatcaataagggcgtcctgaaaagggaagcggagcgtgtggtcggatatggcctgtataagggggcacagagcgctttgcagtggtggcttcccgcactggtgggagtgctggtcatctccaaaatatggccggatattaattatggctttgggcttctcctggcagccggttttttgggaggacacggcaccgcagcagcagttggaacgacaatggcggagctgggctttgccgatgccccggatctggctatgacctcggcaacggtaggcatcctggcgggtgtgttcggcgggctgatctttatcaaatgggccacggccaagggatatactcagtacataaagaactttgcttacctgagcggcgacttaaagaccggtatggtcagcagggaaaaccaggaggagatgggaagggatacggtttcctcaattgccctggatcccctgtgctggcatttgagtattctgatggttcccacaggactcggctatctttgcagcaagctggtaaaaagctattttgccgtcaatattcccaattatgcctgtgcgtttatcctggcactgctcttcttctgtgtggcaggcggtcgtacggacagaggtgtctaccgttatattgataagcgggtgaatacgcgcatcagtggaacatgtaccgactatctggtgtttttcggagtagcgagtatcaagataccgattattgtaaaatacgcaggccctcttttcgttctgatgattttgggcattttcattgtctggtttatactttgtatcctgggaccggccatgaaccgcgacagctggtttgaacgttctatattcgtatacggctatgcaaccggcgtattcgccattggctttttactccttcgcattgtggatccggaaaatgagtctaagacgctgaacgataccgcatttacaacaccatttctcacaccggtggaaacctttgtatgggcggccggtccggcaatgctgatgggtggtcagcactggctgttcatagggatatttgcagcaatgttctttggccttattattgccgcaatggtaatgaaatggtggtatataaaaattccgctgtcggaaagaaaggcgattgttaattacagcggggaagaggaggaacagctatgagaatcgatacgcatccaatcatcggccggatagaaaaggggaggatggtcgaatttgagcttgacggcatgaaaatgaacggttatgagggggaacctattgcaatggcgcttaaggcggccggaatccaaatccaccggtacacatccaaacagcatgaaccgcgagggattttctgtgcaattggaaggtgtacggactgtgtaatgattgtagatggaaagccgaatatccgcacctgtgtgactccgctgaaagaaggaatgaaggtgcagacacagtacggcgtctcggcaaaaccggaggagtgaggacatgaagagatatgaattaataatagttggggccggaccggccggcctctctgccgcgatagaggcggcaaagaggaacatgcaggtggtcgtatttgatgaaaattcccgcccgggaggccagttgtttaaacagatccataagtttttcggttcaaaagaacataaagcaaaaacaaggggatttatcataggggaggaactgcttgtacaggcaaaagagctgggggtcgaggtgattttaaatgccacagtaatcggcctttatcgtgaaaaggaagtctgcgtcatgcaggatgggcagctcgtacattataagggagacaatattatcgttgctgcgggagccgcggagaatatggtgacatttcgcggctggacgctgccgggcgtaatcggagccggagcggcccaaacgatgatgaaccttcatggagtaaaacctggagaacgcattcttatggtgggatccggtaatgtcggcctggtagtcagtttccagctgcttcaggccggctgtaaggtagtgggagtgatagatgcggccaaacgaatcggaggatacggcgtccatgcggccaaactgacccggacgggagtaccgttctatctttcccacacgattgtggaggcagagggcggcgatcacgtgactggcgccgttatagcggaggtggatgacaagtggcagacggttccggggacccaaaagcatctggaggcagatacgatttgtatcgcagtcggcctgtcgcctatgtcccagcttgtgcggatggcaggatgtgaaacagccgacgatccgagaaaaggcggcctggttccggtttgtaatgaatacggggagacttccatcccgggaatctttgccgccggagacgtggtcggaattgaagaggccagttcggcaatgatacagggcagaatcgccggcatggcggcggctgagagaagcggttatctggaagaagatgagatgagcgcattgtttctggaagccaacagttccctcagccagcttcgacagggcatgttcagccatgtaaataagggcaggacagatttaacagagacggatgagggataccggctttcggccagccttctgtcgagggggtatgtggaggactctgagattcaggaattcccctgcgctgtttcccacacgccgggagtgcatccggtcattgaatgcactcagaatatcccgtgtaatccgtgccaggatgcctgccgtttcggttgtatcagggtaggggagacaatcacgtccctgccgcagataagggaggatacaaaatgtgtgggatgcggaatgtgtgttgcaaattgttccgggcaggcaattttcctggtagatgaggactatgatgagagccatgcaagtataacgataccctatgaatttcttcctcttccagaaaaaggggcggcaggaaccgcgctcagccggagcggggacaggctctgccgggctgtggtatcggatgtcaggagcgtaaaagctatggatcacacgaatctggttaccatgctggtaccgaaggaatttgcaggatcggcgcggtttatcgaatttgaggagggataacggaatggaaacaattatggaccgttcaattgatatcgggaaactgattccccagccggacgacgatgtgattgtctgccgttgtgaggaagttacaaaaggggagatccgtcaggctgttcatgatggaatgcgcacattgaatgaaatcagaaggtatctgcgcacagggatgggactatgccaggggcagacctgcggaaagctggttcagtctatcgtagccagggaattaggggtaaaaccgtccgatctccaaatgaatacggcaaggagccctgtcaggcccacggaaatgggagtatatggcaatgagattatagaacagcattctggtgatatgtcaagaactttttgaaaaagattttgatatgtttttcagaaaaaagggtaactttaacagaccttcgggtatgctttgcacgaaaccgaaggtcagttcgatttgatattatattcggcgtccagcttttcgccggtgtacagttggtttttggccagcaatccaaaaacgagtcgtacaaatttacgagatgtaagcgcgagtgctcttttgtgctgatgtttggttacctcagcatattttctggcatagaaatcagcatattcagggatgtgcttcctgacgctgtttgccgcttcgccaagatagtagcgaagatagggacttccggctttcgacattttgttgtcctcagaagtgaaatctccggaatcacccttaggccagtaaagcccggcatatttggcaagggcatcggatgaatggaacacggttatatcgcctatttctgatagaattccagatgcccatatcggacctattccaggtatggattgaaggatgagcagggcgttagggtccattccgttgatgcatttctcaatcgcctgttctatcagcttgatttctttctgataggcatggatgcagttaaacgagcttgccagtgatacgttcagtggttcatacatgcacttgtctaaccggtaggaatccctggctgccttgcgcaggagttccgaagtttttgataggtcagagatgcggttcctgctcttccccgcaaggaaggtaagcagctcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtacggcctaccctgccaaagtctgcgatgagatatgcatctgtgggatcggtcttttccattccgatataggactttcggtaattcgaagtggcctttgggtttacacagaagacgtaaggcttgtagggcatgagaacctcgctggtcgataggaagtttgaaatatggacgctgtatacagaagtggattccagcacgataagaatcgtattcaggtttttatgcttgtgcatacactcagcaatcatattaacaagcttatcggcacccggctggttattgccaaacgatgatgagatgtatttgttttcctcgaagtccatagcatagacagcattggtctttgagcttacatcaatacctacaaacaaggtggacatatagttgagctttaacatgatatcacctccattccgatggggatttgtgaagcctgaagcaaaaggtttatcctgtgctgcatacggtgaccgaaacctcgcgcaatgagcatgcacccagtcagccttttttgctggggctaccggctggggatgaaaattctgtgtaagcggaatgtgccatatgtgccaggctgcatgctattcgggcagtctcggacgaagccggctgaaaggaggagaagcagtgccttcggacatcagactctgctgatatcataacacagaataaaccatattaaaatgtaacgattaactgtatagatgggaatcgggatgaggggagtacctcttagatatccttaccatttataccaaaaaagaataagtctgtaagctgtttttcttgcttacaaacttattatacgaggagggaaaagatgaagcataatgcacaagtggtaatagtcggaagcggcctggtcggctgctcagcggcctattatctctgtaaacatggcattcagccgattgttcttgagaaaaaggaaatcggacacggtggttccagcagaaatgcggggggagtccggcagtctgcaagagatcccagggaacttccgatggcgatgtatgcagtcgaaaatatttggccgggactcagcgaagaactgggaattgacattgaatacaggcagaaggggaatctccggcttgcgaagacatctgagcatatggcgattctggaaaaaacggctctaaaatgccagtcccttggtcttgccatgaccatgctgtcgggggaggagacgagaaaaaagaatccatttatttccgatgaagtgattggttccagctggtgtccgacggacgggcatgccaatccgcttctgacgactctcggattttataaaaaagcccgggaaatgggggccagatttatcacgggagaaaaagtcgtttcgctcaggaaagagagaggaagaatctcaggcgtagtcacaaaatgtaatgaatacggagcggaacaggtaattgtcgcaagcgggtttgagagccgggagattctcaatacggttggaattgatattcccatgcgtaaaaagctgttggagagcctggtgacggaggagatgccgtatatgtttgacgaaatgcttggtgtggcgacctcagatttttacgggcatcagacgaagcatggctcctttgtcttcggcggggacgcaggatttggaaattattatgatttccagaaggagacgatgtccaccagcctgtcgccgtccgtgatttgccgtggagttctgcggtatttccctatgctctcggaaatgaaggtggtacgtgcctgggccggatggaaggatgaaagcgccgatgggattccggttatcggtccgattgaggaagtgccgggactttacgctgcctgtggtttttcgggacatggtttcggcattgccccggcagccggaatggagcttgcgaacctgattgccggcggaaaaagcgtgctggatctaagagagttaagatataaccgttttctcccgaaaaaataggatggaggtacacaatgaaagcatttacattcaatatgcctgctaaaatctattttggggcaggggtaagcaaagatttatcggagcttgcgcgccggtttaacgcggacaaggttatgctggttacggatcgggtgatcggaaatacaaaaggttttgccgccatcgcggagggccttgagaaaaatggaatacaagccattgtctacgatgacacgtcaccggaaccgccggtggaggcagtggacagagcggcggatgttatgaggacgagcggctgtcagatggcggttgcggtgggcggtggcagcgctatcgacagcgctaaggcaatgtgtatgctgtgtacaaatgaaggctcggtccgggattatctgtttggaggaagccgcacaattgaaaaccgcccccttccgttagtctgcgtcccgacgacggccggaagcggaagtgaggtgaccgcatccagtgtaatatcggatccggagaggggaattaagctgtccgtaacccatgaatggctgattcctctggctgcagtgattgatcctgttctgcatatggatatgcctcctgttattactgcgtcgaccggaatggatgcgttgacccatgcaattgaagcgtatgtttccaaaaacgcggaacctttgtccgacgcgctggcccttgccgccattcgtttgatagggcagaatatccgcactgcaacataccggccggattgcctggaggcacgctccgccatggcgctggcgagtctgatggcggctgcagcatttgtcaacggaggtctgggagcagtgcacggtatatcccaggcaatgggcggaattgcccatgtgtcccacggaatcggcaatgctctgcttctcccctttgtatgcgaagccaatctgccgggtaatatggagcgctatgcacagattgcaccactgctgggagaacggacggaggagctttcactccatcaggcagcccgctgctgcgtagatgccatccaccggatgattaaagagctggggctgccggccgcactgcatgaagttaaggtaacgagagagatgtttcctgatattgcgaaagggggcatggaataccggcttatgccgttgaatccggtacctttgagcgagaaggagatccttgatattttagaaaaagcatattagaatttagacgattatatctgaaaaataaagagggcggaagtgtttccgtcccctttgcattagcggtcacgcttcagcgcgcgggtcttacttaaatgcaggcacctacactcccgccgaaatcggcgctggcagactatgttacagcccgtcaaatcacccggcacggcactacctcttttaacttcacggccctggtcattataaagctgggaatattatgctccttcagattgccttcatcgtttgtatcttccaggatgtgcgtcaggaggaatccggcctccagctgtcctcctatctgatcctccagtgtatgggagaactgtaccccgcagtccgtatcttccaattgtttcatatggttagcattttttaacggattgaagggcagagagtttgtcagcattttttcatcgtggtcaaaaatatagttgattccggtgtcaagacctgagagcattacgcccttgtctttcaaaatccggtagcattccctgaagattggcttcacttcctctacatagcaattggaaacggggtggaaaatgagatcaaagctttcgtcttcaaagggcagcggttttgtcatatctgcgcggatgatttgaatatcatagccttcccgggccgccaccatccgctcgctttccaactgcttcggtgaataatccagcacggtgcagtctgcgcccgccgcggcaaagagcggcatctgttggcctcctccgcttgccagaccaagaactttttttccccgcaggcggccgaaccactctgcaggcaccgttttgttcggggtcagcactacgctccaatcgccgcgtaaggcgtgttcatattcttcgtgtgagatgggggtgccccacacccagccgtcttctatccaacggtcaattgttttcgcattaatatcctgatagttcataattataattactcctttaagcgcacctgattatcagcgggtttcctgttttacttgtagctgcgattatccctgtcatttccactgtaagccaggagggcagtcctgtcaagttattacttacgtcggcgtgaatcacgggatactcatatgaaatgaaggggcggcattccggctaaaatccggcttgccaaccgctcctgtacaagttaaactgatatcagacaggcataacagggtaacagttcatgctgtcggaactgttacataacaggaggtggcacatggcatttacgatttatgcaaagatgaaacgagtggggaaacaaaaaaaggaggatttgctgccggttccgtttgaactggaaaagagaccggacacggtgcgggagcttgtgacggctctggtacggctgtccgtatcggaatataacgagcgtaaagatgaggggcaggtgctgcggtatctcaccaaagaggagataagcggactggcctcggcaggaaaagtctcgttcggcgttcggggcggcaatgatgcggatccggaaaaagcggtcgagaatgcgctccagtgcttcgaggacgggatttaccgcatatttgccggagaagaggagctgaccggactggaagagccggttccatgggtgaacggggcagaaggtaaagaaggtaatgaagataaaggagacgataaaaccccggtatttacgtttataagacttacaatgctgtcggggtggtaatggaaacggagggttttgatggcagattatacatatcagacaaggcggaagatgacggaagactgggttgcccatgtaaaggagaaagcaggtcatttgtcgaagaatgaaaagcagcttctgcccggggcagcttaccattcagttgcccaggcaccgcaggattggatgagggggcttttggacagcggtaaatatcaaaagctcagtgatttatacagaggggaactgccggggcttgttaaggcgtgtgttccggaaaaactgacagaggaattttactatgcgctggatcagatgaatcagtttcagatgacggctggatggtaccgccgaagcgtccgttctgacagctaccgtccattcgtctatcagagcgtacagcttttatgggcttatgcccggctggaattttacggaggctctctggccgatatcttaaccggccggatcgatccggagcagtatgatcacgccagaacagaacgatggagctatgcagaaatactggcggcgcagatagatcggaaggaagaggcgacgatacaggcggtgaaggacatacttctcggagagggaaataccctgatgatcagccacaaactgatacggggtattgtcatgagcaaaaacacagaattgtacgagatactcggaaagttcctgctggcggcacgccttcaggaaggggcgaggcaggctgtctgtgagacgatggatgcaggccgcccggaggcatttctacatctgttcggtgtcattgaagaaaataacctggtacgatattcttccgttaaacgggcagtcagcacctggatcggaatctttgatgaaaaaagtgcggagcgtatcactgaaaagctggttcgtctgatgggacaatgtctgagagatgacggtttctgccgggaacagcttgcctccaatgattctattgccatcagctgcggactgtgggcgaaaggattttacgatgcgcagcaggctgtcacggaagtcctggagctgatccgccatggaacgaagaatcagaaaatgacagcgtcctattttaaccgttctcttcagttcggctatttaaaacagaaggcggcaaaggaggcgattctgagctggccggatgatttggagctggcggcctgcttcctcccgagctttatggataacacttaccggtgttttacacagctgttagaggaaaaagacgggcgagcttatcttcagctttgcgacggcaaggtcaggaagccggataacctgccggtgacggaaatctttgaaaatgagaaggaagccagaaaggtttacattctgttccgggatatgttaagccggattccgaaaaagggtatagacttaaatccctgcatcttcccatggtaccgtgtgacgatgacgcagtcggatattgccctcaggatgtgcctgattgcctggatgcttcaggatgaggcttatctggatgaggcggcgcgtctgattccgattgtcggccagggaaatacgtacggcgcagcgcgtgctgcagcagccagggtgcttttataccggccgcagacaccggcgcgcagggaagcgctgtttgagctcctccacaatccggaggaatatacgatgcagtcggcataccggctggcggaggacatggaactgacggccggggactacctgataattgaaaagaacctgaaatataaaaaaggcagggccggtgtcctggctcttcttcggaaacaggaaccggcagcgctgcgggaatcggtcggccggcttttggaaacgggctcggaggaatgccgtatgggcgccctcgatctggcgcttcagattaaaaaggaagagccgcaggaatttgcagccgtcaggcccctccttgagacgcttaccgggccgacgggacgggaacaagtgattcttggagaacttctgggaacaaaaagcgaggctcaggatattttgaatacaccgggcttcggcctttatgatacaacgaaagagtggcttctgcctcctgtggaggtggacgaaaaacagtctgtaaagctgtttgcaggcggcgaagatgcgtgcatccagattctggagcggctgaacagcctgattgaagagaaaaatgagctggagtacaagacggcctggggcgtagaaatgcttctgggcacaaagctggataactgccggtggatccacggggatccggaggcagagccgttagatgccctgccgtttcgggaactgtgggaagacttttacaggaaagagattaaaacggaggaaatgctgctggagctttatctgtatcaaaagtgccgggcccagcgcaacgactacgaaaggaatctggagctgtacaggaaagtgttcggcagcgggcttttgaaaaaaccgccgtttaagaagctggtacagggcctgcgttatggagcgcaggcggggacagtcatagacactttgtttacccagtacgttccggcaggcctgaaagcccggtggggacttacagggactgcaaagctgctggcggtgctggaagcatccaatgcattttatgaatgtgaggagaaacggtggaatggagagaaggaatgttttacaaaacgggctgccgagcttcccatctttaaggaaatgcgctggtggctgtctctcgcggacgaaggcgattggggaagcgcctttaccctgcgctttaagcttcaggagttctatgataagctgagaggcaaagaggttctccgccgatatgacagagtaagggccggttatctgactcttgcggactatgtggactgctatgtaaaaggcatttgggacaaggatctattctacaaagcggtatttaccttcctgagccttaagagtctgattggacctgccagtacagtggagcaaaaaggggctgtctcatccagggatgcacgtatcggggaactgaatgccttttttgggcagggggtaatccgcccggtggatggaaaatatcattttgaccagatcggggatgaggtaccggcaatgaagctggcccacgaaatctatcaggaggcggttttgctgatcctgaaggtggaattaaaaaggggggagcaggagaccccattctcaggatacgtatcatcgattcaggcgatttatggcatcgatgtgatgattcagattctgactgcgcttgggaaagagacattacagcgcagttcaggctattattcaagtacaaccgagcggaaagccgttttaagccatctgctcaaggtgtgccggccaaagccggaggagacggcagaagacttgaaaaaagccctgaagggaacggatatcacaaggaagcggctggtggagctgggcatgtatgcgcagcagtggattcctcttttggaggaatatttgaatctgccgggattccagagcggctgctattattttatggcccacacaggggaacggctggatgagtttaccacctccatggtagctaaatttactccgctcaccccggaggagctgcaggacggagcttttgatatccactggttcttcgaggcatatgaaatgctgggagagaaggagtttaagcttctctacgatgcagccaaatattcttccaccggggccgcccatgcccgggccaggaaatatgccgacgccgctctcggcaaagtggagaaggaggcgttaaaagcagagatagcggagaagaggaacaaagatctgctgatgagtatcggacttttgcctctcgctccggaaagtacggatgaagaagagcggaagagacgggaagaggatttgctcgaccgttatcagtttattcagaagtttcggaaagaaagcaggaattacggtgcgcagaggcgtgccagcgaaggccgggctgctgcgctcgcgcttcagaatctcagcgtcaatgccggttttaccgatgtaacaaggctgacgcttcggatggagaaccggctggtggagacaatggaccgttattttgaatgggcgccgcttgatgagctggaactcaggattctggtggatgaaaacggaaagagcagtcttcaatgccaaaagggaggaaagctgttaaaagcaattccggcaaaatataagaaaaatgagattgttgcggaatatcaggaggtcaataaaaagctgaaggaacagtacagcaggacaagacagatgatggagcaggcgatggaagacaggacgtcctttgagatatgggaattcctggagctggcgaaaaatcctgtcgtccgtccgattacctcccctcttgtagtaatggtagcaggagaagccggcgacctccccggcagcaggttatccggcaaaacggccgcttcttatgacggcgaggcagcagagggggccggaatgcggatgggattcctgacagaggaagggcttagagactggtccggtacactgacacctgtaaagcgggatgataagatcctcatagcacatccctctgatttgtataaagaggggcattggcatgagtatcagaagttcttatttgacaatcagatcaggcagccctttaagcaggtgttcagggaactgtatgtgaagcttcaggaagagcttgataaagacgactcaagaatgttttccggaaatcagatccagcctcagaagacagtcggggccttgaggagccgccgctgggttgccgattacgaggacggactccagaagatttattataaagagaacattgttgccagaatctatgcaatggcggactggttctcgcccagcgatgtggaggctcccactcttgagtgggtggtgttctccgatcggaagaccttcaagcctctgaaaatcagggagataccggatgtgctgtacagcgaggttatgcgggacgtcgatctggcggtcagcgtagctcatgcgggcggagtcgatccggagacaagtcattcaacggttgagatgcgcaaggcgattgtggagtgcaatctggaactgtttaagattaaaaatgtccgcctggaggggagccacgccttcattgatgggaagctggggcagtatacggtgcatctgggaagcggagtggtccaccagatgggaaatgcgatgctgttcgtagtgcctgtccactcgcagcaccggggccgtatcttcctgccgtttgtcgatgatgatccgaagacggcggaaattatgtccaagattcttttatttgcggaggataataagattaaggatccaaccattctggaacagattcgataggattttcagatataagccggacataggataaaaaagaggaagactatatggttaagccatatggccttcctctttttggtgcgttcagataatgtaatattatttcaaaagaaacaatccgatctgtagatagtgattgtgcataatgcatataaaaccattggaatatagaagataacaagctataatataatacttttaacgaaaattgaaatatatttacaaaaatacatgtatcatattgaaaaaaaattacagatatgatattattcgaatgtaataagaatacaaaacaatccagcataaaaaggataaggggaggagttaagatgaaagcagtagttcttcatggaccgaacgattttgcgacggaagagatcaaaaaaccggaaatcggagatcacgagatgcttttaaagatgagaaaagcagccatctgcggaacagacatgagaattttcgcaggaaccaagactaagggaatcagatatccttcggtcgtcggccacgagatgtgcggcgatatctgtgaagtcggaaaagaggttgagggcttcagggcgggggacagggtttccatcgcaaatgtgattccgtgcggttcctgtccggcctgtctggaaggcagggagaatgcctgtatgaacagaaaggcgattggctatgagttcgacggcggttttgaagagtacgtactccttcccgagattctgataaaaagcggtaatgttgtaaaattaccggaggatgtctcttacacggcgggagcgctgatagaacctctggcctgctgtatcagagggctcaaaaatgcagggacaggatttaacgatgtggtcctgattgcgggagcagggccaatcggcctgatgcatatgcagctctccaaaattgcaggcgcaaaaatggtcattgtcagcgaaccgaatgagatgagaagaaaagcggcacaggaactgggcgcagatcttacggtaaacccgatggaagaaggtttacataaaattgtcatggatgctacaaatggtatgggagccgatgtcatcgtgatggcaatcggagttccggctctcgttaattccaccctgaagctctgtaagaaggggggaacggttaatctgtttgcaggttttgcggggacgggggaatgcacgatagaagtcaacacgatccactataacgaaatcaatgtcaacggcagcaccgcatacaagagaatagattatctggaagcggccgacatggttatcaataaaaagataaacctggacaggattgcaaccgacacctttaaactggacgaattcaaagaggcgtttgagtactgtaaaagcggacagggcctgaaggtaatgattgaaccgtaagcacacgaaaatgaaacaagtaaataaccaaacagaccaaatcaggaggaaaagaattatggcaatgttaggaaaagaaatcagaatgagcagattagttaatccggtgagcaataaaatgatggccatcacggtagatcatgccacatccagaggaatcgccccaatgaccggaattcaggacgtgcagtctgcaattgacaaaatcattctcggcaaaccggatgcaatgacaatgacaaagggaattgcggagcgctgcatgtaccagcacgcgggaaaggtttctattttaatgaagatttccaactactcccctgtggctccgactaaagatacaatctttggaaccgttgatgaggcaatccgtatgggagccgacgcagtatccatgggctgtatgacgcttggagacttccagggcgagcagttcgaggcaatcggcagagtggctgaggaatgtatgagaaaaggaatgccgctgatcggccatgtttacccgaagggagaaagcgttccggccgacaagagaacggcatgggaaaatatcgcatattgcgtcagaagcgcctgcgagctgggcatggatattgtaaagacaacttacacgggagatccggacagcatggcaaaagccattgcctgtgtaccgtcgagcttcagagtcgttattcagggcggagattcatgcaagacactggacgactatctggaaatgacgagagaagcgatggactgcggcgtaggcggcgtgacaatggggcgttttgtatgggactacaaggatgtgacggcgcttgtaattgcgctgagatacatgattcatcacggctacggcgtaaaagaggcgaaagaattgctggcccagcttgaaaatgataaaaattacggagacttttaataaaactggggcacggcagcagagggtaatgaattatggcggggaaatacttattaggcgttgacgtcggcaccaccagcgtcaaggtggcggttatcgatgaaaatgccggcgtgctggggatcagcaaaagctcctacaacctgattactccggagccggattaccagcagatagacacagaagatatgtggagagcgtttctgaaatgtgtggagcttgtatcggaaggcaaggggcttgatttgtcacagattgcgggaatcggaatctcaagcctatgtcccggtctcgccgcgttcggagaagatggagaggtgctggtagacccgattctgtattccgacagaagaagcacagaagaggcagagataatcctgagcgcggtgggaagcgataagctgtttgagataacggccaacaccgcgatggcgggagctacatccggaacctccatgctttggattaaacgcaatctgccggagatttatgaaaaaacgaaatatttcggccatgtcaatacgctgatggccctgaggatgaccggacggtacgcaattgattattccaacgcgtcctacagcaattttttcgagacggccggcggcttcaaatggtcttcccatatctgtgacaaggtcgggatcgacatggaaaaactgcctcctcttctccattccactgatgtggtgggcggtcttatcaatcaggagctgattggaatggggctgaaacaggggacgcctgtggtgataggaggcggtgatacggcctgcgcttccctggcggtgggagtgacaaggaacggggatgtatgtgagtcggtcggaaccaccaatgtgctgacaatctgcgtggatcagcccaaatttgaccacggcttcatcaaccggtgccatgtggtggacggaacctggatctaccagggggcaatgtcccatacgggagcggcctaccagtggttcaaggatgagttctgcaaggatattcaggatgaatcggaactgacgcaccaggatgtatttatccggatgaacgaagaggcggcaaaagcaaagccgggctgcggaggccttgtgttccttccctatatgctgggggagcgcagcccggtctgggacccgtatgcgagaggagtctttttcgggatttcccttcataccaccagaaaagattttaaccgcgccattatggagggctgcggatacggactccgccagctggcggagatagccggacgagtgacgggaaagcatatcggggaatttgtctccatcggcggaggcgccaagagtgaggtgtgggcacagatcaaggcggatattatgggggtaaacataaaagtcctggatctgaatgatatggctcccatcggggcggcgcttttagccggagtcggggccggatgctttgcagacgtctatgaagcgtccgcgaaggtggagaggaaggtctgccgcgaggtgacggcctcccacagcaatgatgatgtatatgagcgggggtaccgggtctatatggagctgtatccccggattaaagacctgtataaaataacaagcaatttgcattaagaggaggatttcattatgagcaaaaaaattttggcggttgttatggctgcggcaatggcaatgaccgggctggcaggatgccagggcaaagggacatcgacggcggcaactgggggagacaacggtgcagcgccctctgccgaagcaacaaaaattacgatttgcgtgccggatccggaggcgtcatatatctatcaggcggctcaggagtttgcaaaacgtgcggaagaatattcaggcggcactctgacctttacaatatcgggaaacggttccctctacggcggggatacggcggcaggcatcaaacagctttcggccggttcacttgacatggttattctggccacctcggtctatgccagctttaacccgggattcaacgtgatctccgtaccgtacatgttcgacgatcaggcccagcttctcaattatctgaacagcgatacgggaaaagggctgatgaacagcgtatctgagatgggaatcacaacggtgggaagctggaccagatcgtttcggaaggtcacaaattccaaacgtccggtcaatacgcccgaggatatcaaaggacttgtgctgagagtgccgaacaattccctttatgtggaattcttcaaggcatgcggcgctacctgtacgccgatgaacttcagcgaggtatacaatgcacttcagcttaagacactggacggccaggagaatccgattgacgtaccgtactccaataagttttacgaggtgcagaaatatatttcccagaccgaccatatggcggacgcctggctggttggattcaacacggcaaaatttgataaactgacggatgaacagaaaaacgcgatcacaaaggccggtgaagaggtgcagcagtggaatgtggaatttatggaaaaagaagatcagaccgctcttcagacactgcttgacaacggtatggaatataatgaagtttctgccgagaaccgccagctgtttatcgacatttccaagagctgctatcctgtattcaaagagctgattgaagatgaggaattatttaacgccacagccgaattctgcggcaaacagtagggcagaggccggcagacgggagggattgcgaaatgggacggaagaaatcaccgctttataaattatttgactgcgtggactttttagagaatgttatagttggggttgcacttacagggatgttttttacaattatggcccagattatcggacgattggtagcacatccgtttccatggacagaagagacaacacgatatctgtttatctggatgatgtttatcgccctggctgccggttttaataaggcggagtcttcaagagtcgttttgttcctgaatctggggccgaaatggctgaaaaaattcagtgaggttttatatgcggtaattgtaattggctttttcggttttatggtgatttacggctgggagctggttatgcagcagaaaatgctgaatgagatgggaaccgcgctgcggattcctatgacgattataggattttgcgtaccgctctccggtgttctggggataacaggcacgatccagagctttctggaatacaggggcaatgttgcaatttccgatgataccaaagcagaaggggggaatgaagcatgagtttagttcttcttgtactttttatcgtgctgatgtttttgggcgtgccgatcgcggtttccctcggagcagcctcggttattacgattatcacgatgtcggatctgccgctgagcatggcggtgcagtcgatgtttacctcgatgaacagcttcatcatggtagcggttccgctgtttatcctctgcggctcgctgatggatgagggcggcgtggcagaccggatttatgaactggcagatgcgggcgttggctggatttacggcggactcggccatgtttccgtagtggttaacatgctctttgccggaatgtccggctcttccgtagcggcaatcgcctctatcggaaagatgagcatcaacgccctggctaaaaagggctatcctaaagagtatgcgacggcgatcaatctttcgggctccatgctggcctcggtgattccgcccagcattctgatgattgtggcggcctccacggccaatgtctccatcggccaggcgctgattgccggtcttatccccggaattatcatcggccttatctttatggcgtacaactttgcttactgtaaaaaacacggaatcggagaccgctcaagctttgagctgaaacggcttggaaaggcatttctcaccgccattcctgcgcttctcacccctgtgattctgttgggcggggtatttaccggattttatacgccgaccgaaggcgccgcaatcggcgtaggctacacgattcttgtgtctatttatgtatacagggatttaaagtggagtgatattccgaggattatctgcaaaaatgcgagaacgacgggaacgattctgtttgtggccattacggccaaacctgcctccctgatttttgagatggacggacttccaggacgcgtggcgaatatgatcatcggagtatccgataaccgcatcgttatcatgtttattctgtatgcattcctgatacttgtaggtatgtttatggatgcaacggctgctatctacatactggttccgattcttcttccggctgtgatttcagttggagtatcgccgctgttttttgtggtattccttgtaatcacactgtccttcggattaattaccccgccggtcggcgtgtgcctgtatgcagctcaaaatgtcacgggcctgacactggaaaagataattaaagcgtcggtgccgtggatcattctgattgcaatagcgctgtgtattttcatcctgtttcccggaattattaccgggccggtgggaatgctgttcggtgttactgttcacaccatgccataaagcggcatgctgcaaacaataacacgcttcgcgatgcacagaaactgcaaaaaacgcagtttcgcgccgtgtaactcgggattttcgtgcagaaaacgcacaaaaacacctcgcgggacataaccatgtgaacagtaacggttcggttcataaacgagagggaaaaataggaggtaataatgttgaaaattgttatattggacggatatacggaaaacccgggcgatttgagctgggaaggttttgaggcgctgggggatgtgacggtatacgacaggactccggaagataaaattgcggagcggattggggatgccgagatagtcatcatgaacaaggcgccgatcaccggggaaacaattgccgcgtgcaggaatttgaaatatatcggcgtgctggccaccggatttaatgttgtggatacagaggcatgtaagaaggccggtatcgtggtggctaatatcccaacatacggaacggatgcggtcggccagtttgccgtcgcgctgctgctggaaatctgccatcacgttgcccaccacagcaatgctgtctatgagggccgctggggggataatcccgactggtgtttctgggattacccgctgattgagctgtcaggcaagacgatggggattatcggtttcggccgtatcggcagggcgacgggcagaattgcaaaagcaatgggcatgaaggtcatagcctgtgacgaatatccaagcccggaggggaaagagttgggaacctatgtcggcctcacggagcttttagcgcagtcagacgttattgccctgcactgtcccctgacgccggagaatacggggcttgtctgcagggaaacgattgagaaaatgaaggacggcgtgattattatcaataattccaggggaccgctgattaatgaagcggatctggcgcaggccctgaattccggcaaagtttatgctgccggtctggacgtggtgtccgctgagccgattcgtgatgataatcctcttttaaaggcaaagaattgtttcattaccccccatatttcctgggcgccgaaagaatcaagacaacgtctgatgaatattgccgtggataacttaaaagcgtttctttcaggaactccggtcaatgtggtgaatccgtaatcaatgcacagaaactgccaaaacgcagcttcgcgccgtgtgactcgggaattttatgcagaatacgcacgaaaacacctcacggaatagaaccgtgtaaacaataacagggatttttcagcggaagttgaaaagtcctttttgtcttttcgtgaaatatcttaaaaagtgcccgcagtatgatataatggtaaaataaaaagccgccggcggcatcaggcagcacaaggcagtaaaggaagatagggggaatatgtgtggttgaagtaagctgtaaagaaaagattatgggaagcatgcatctgctgaccaacagtgagagtaaaatagcaaaatacgtccttgataatttcaatgaaacgctgaattttaatgtgtctgaactggcggacaaggccggagtcagcgacgcctccgtcgtccgtttctgcaagagtcttggttacaaggggttccaggattttaaaatcagcgctgcgcaggatattctgccgcgggaccgctattttaatccgagcctggaacagaatgacgatgtgatgacaatatgcaaaaaaatatttaatctggagatggcggccctcaacagaaccttctctctgattaattttatcgatatggaagcggcctgcgaggccatcagcaaagcggataaggtgctggcaatgggcagcgggggcagtctgattgtggcgaaggatatgcagcataaactgatgaaaatagggattcagtcatttgtccatgacgatatcgacttgcagatgatggcagcctcccttctgacggagaaagacgtggcaatctgtatctcccattcagggagcaaccgtaatatcctgagcggcctgaagctggcgcacgataaaggggccacgacgattgcgctgaccggccagggaaagactccgattgccaatacagcggatatcgccctctatgtggcctctgagaaaacgatgttccgttcggaatcagccagcaccaggatagcccagctttccatgatcgactctatggtatcgattatagcatttaaaaattatgagaaatcttaccgtgccgtccagcagacgagacaggcaacggcagagaataaattttaacgcacatacaggaggtatgggatgaaggttacaattgcaatcgattcgctgaaagggagcctgacctctctggaggccggacaagcggcggcagaggggatcaggagagtatacgaagatgccgatatctgtatccggcccctggcggacggcggagagggaaccgtggaggccctggtccgcggaatgggcggggaacttaaaagaatcacggtgacaggcccactgggaaagccggtggtctgtgaatacgggattatcaaagagagcggcacggctgtcattgagatggccggcgcggccggaattacaatggtggacgaggaagagcgcaacccgctttacacgacgacatatggcgtcggggaagtgatccgggatgcggtcaggagcggatgcagaagatttgttgtgggaatcggaggcagcgcaaccaatgacggaggtatcgggatgctgcaggcgctgggatacggtatccttgataaggagggcaggcaggttccctatggggccagggggcttacagaaatcgcgtctgtaacagacgataacgttttgccggagctttccggctgtaccttccggattgcctgcgacgtgacgaatcctctgtgcggagagcagggctgcagcgccgtgttcgggccgcagaagggggcggatcctgagatgatccggcagatggacggctggctggaacactttgccgctctttcgcaggagaagtacccggctgccgatccgctccgtccgggaacgggagctgccggaggattagggtttgccttccttggatttacaaaggcggtgcttgagtcgggcgtgaaaattgtgctggatgagacgaagcttgaggactatgtaagagacgccgatctcgtcatcaccggggaagggcgtctggacggtcagaccgtaatgggaaaagcgcccatcggagtggcaaagacagcgaaaaagtatgggaaaccggtaatcggcttttccggctgtgtgacgaaagacgcagtggcctgtaaccgggaaggaatagacgcattttttccaatcctgagaggagtggtgactctggacgaggcgatgaagacggagaacgcaggtgcgaacttagcggatacggcggagcaggtgttccgtctgatccgggccatggcatagaagagcaagacataaaaaccaataccggcctctgcctggcagcagaggccggtaccggcttttatgggttcaaagttcagtgagagtctgactgccgaggtgttcgagggtcctgtggcagtcattataaggataggttgaatatatgtaaaggcttgttaagccagtttaccaactgctttttcaacggcttcaacgaattcgccgtcttttaatactttgaaaatcttgttcatatctttgtagattgcgcggtctgtctccataaaggatacctcgcggcgtaccaggtcgtaaacagcctttgtgccttttccgagtttgtcggcgcccttgaaatcagcggcctgagcagcacagataagctcgattgccagtacatgctccgcgtggtcgatgatggtggctgccttacgggaagcgatggtgcccatacttacatggtcttcctggtttgcggacgtaggaatgctgtcaacgctggccggatgcgccagaaccttgttctcggatacaagagctgcggcagcgtactgtgcaaccatgaatccgtcgttgattccttcctctacacagaggaaaccgggaagtccgctgagctgcgggttaacaaggcgctcaattctgcgctctgcaacattggcaaattccgccatggcgattcccagagtgtccattgcgatggcaacaggctggccgtggaagttaccgccggagaagatgtctccgttatccgggaagatcagcgggttatcggttacggagttgatttctgtctcaattacgcttcttacatagtcaaatgcaagacggcttgcgccgtgaatctgaggcaggcagcgtaaggaataagcatcctgtacacggatctgtccctgtctggtggtcagcttgctgtcctgtaaaatctgaagcatatttgctgcgacatcgatctgtcccttgtgcggacgaaccatctgaattcttggatcgtaaggatcgatgataccttccagagaatctacggtaagagcagaagtgatatctgccatctttgttaaaatttcagcgtcatggatagccaggctggctacacccagcatagcgcaggtgccgttgattaaagccaggccctctttcgccttcaatgttacaaccgggataccggcagcttccattgcttcgcggccttccatcactttaccctggtattctgcttcgccttctccaatcataggaagaaccatgtgagccagagggcacaggtcgccgctggaacctacggagcctttttccgggattaccggatgaacgcccttattcagcattgcaatcattgtctcgactgtcgataagcggataccggaaaaaccttttgcaagcgcattgacacgcagcagcatgatagctcttgtcacgtcctgtttaaatggatcgcccacgcctacggcgtcggataagataaggtttaactgtaatttgtccagttcattttctgatattgccacatttacgaatttaccgaaaccggtattaagtccgtaaataacttttttctcttcaatatttttttccacaatgtcacgggatatctgaatatttttttttgcttcttcgcttaagcccacctctgccttgttgcgggcgatttctaccacctgatcaattgtcaggctgctgccgtccagataaatcataatatgtaaaccctccaatcacgtaatttgccgcttcggcggccgttcgttgttttgttagttacagtctacacccgggctgtcgataaactgtcgatgcaggggcctgtactaaaagtatattcctttttttataaaaacagaagcgtattttttatcgtcgttttgattttttaccgacgatttaggaaaaaagtgttttggatcatgttttttcttgtcttttgtatattctaaatgttaatatgataacgaagggatggtagaaaattacatggatgatttagagcagtacaaagacagacttcgtatcgcattaagctccgcaaaaatctgcatttttgaggtggatctgctgcggcagttatataccttttttgaaaatgcggaggacatattcggcgtctccggtgatagtattttaaaggatgtgcagtcatacagcacactggctccggaagcgtaccggctggctgtcagcaaatatttttcacatccggacgattcggcagtgattgaggcagcttttgcacagatcctgagaggagaaccggccacctatgaggctcggatgaaagcgggaggctcggcgttcatatggtgcagaatttctgtgacgccgattatagaagatggcaagccggtaagaatggttggcgtgattacagatatcacggatttgaaagaaaaaacagaaagtttgcggagggccgtcaacctggactcatttacgggtctttataataaagatcacacgatagcccttatcaataatattttagacatgggcacgcatgtgaaacacgctctcgtgattctggatatcgataattttaaaaaatttaacgatacttacggtcatgaccagggcgataaaatcattaaagcattgtcacagaaactcaaaaacacgttcagaaaaacagatattgtgggacggtttggaggcgacgaattcattgtatttatccaaaatatcgaagacgatcaatggctgcgtgataagctccatcatcttatccgttttgaagcaggaacatttacctgcacgagcagtatgggagtttccgtttttccgttggatgcggcaaactttgaaatgcttttcaaaaaggcagacattgcgttataccacgccaagtccgcaaaagagagagctgtgtttttttcggatcttgacaggaatgaaaaaaaggattctctgaggtaaacggcgcctggttttacaagagctgctgttaatggaaagttattttccgtaattccttacaaaataaacttgtgtttggttgcgtatttatcaaatatgcattaatattgtagcaggacactttgacgggacttggggaggccttgtttgatgagagatgtaacagtaacgctaatgaatacgccgtccgtggtggtggatggggaaaagaaagtatttccttacaggaaagtcgaaggtttattttactatatctgtgtcagaaaacggatcacaagggatgaagcgatagggattttctgggttgactgcgatgagaccagcgccagaaaaaatctgagggatgctttatatcacattaaaaagatagtagggccggatatcatcagcatggatgggaatgtatttatatcgctgaatccggagcagcatattaaagtagatgttgacgccgccagggagaatatcctggaaaattacaagggcgagtttatgagtttcttctatgtaaaaaactgtctggagtttgaaaactggatggacgattacaggagagagctgaaggagcattatattaaagccgtcttaaaaaaggcggaacaggctatacacgctaaggacacgtcggaggctgcccgttatgcaggcaagctggtggaagttttctatttagatgagagcttttacagacgggttcttacatttttgatggaagaggcggaatattcatctgctatttccctctatcagaagtttgcattgtcgctgaagcaggatctggaggaggagccggaggcggaaacccgggcgctgatggacaagatcctgaagctgcgcaagaagatagcagagcatcctgtaaaggagcagcaggtcttcatgggccgtcagaaagagctgtatggcatttatgagagcatccagaaacacagggtgaaggggaaggattccggagaaaatttcgttcttatatctggggaagcgggcgttggtaaaacggctttgatggggcagctccggaccctgctggaggaagagaaccacacggtattctcgtactgctgctgtccttcggagtctgatttgtacctgaagccatggaatgatatattaagccaggtgcaggagttctgcatgaagcagaggaaggaactgaaggcatctgaatactttgccaacaaagatgtgacggattaccgcatatttgcgacgcagtacggtattcatctggaggatttaatccgggctttctgcaaggacttcggccgctcggaaatcatcctgtttttcgatgatatccagtggatggatccctcgagtatccagctattaaataatacgttattccaccttagggactgcccgatttttatcgtggcggccagcaggctcgaggtcgtaaaagaaattgaggatttacgggtttctctgatgcgggaggcattaatcaaagaggtaaagttgaaacggttcactctggaggaaacgagagaactgattgaggttcaggcgcaggaactgctgggcgatccggaaaacctggacaaaatttatgagtatacggatggaaatgccctgtttctgaccgagcttcttaagacaatgaaggacaacgacggagggatggtgccggagaatccgctgacctccaggatggtgagtatcatccagagccgtctgatgaagctgacggaacaggagcatacccttttgagtgtgatgtcggtattctatcatgcggtgacaatcgaggatatccagattctctatccggaacctgagcttaagatatatgatttactggagcatcttttggagcgacagattatctatgaggatgtggggactgcagccattacgtatcattttacccatatattgatacataactatgtccagtcgaagatatcggccggcagaaagcagatctatcaccggcaggtagccggatattatgagcagaagtacaaggagaccggggatatcaccttgatgccggaattgatttaccacttcgaaaatgccaatgatatgtacaaaaaatatgagtacaagctggagtatttcaaggaatttttctcaggaacccaggagatatatccggccatgtctttgagctttacggataaattcttcttcccggatctggattccagcgaaaatgtgctgattccgttggctgaggagatacgcgcactgccgaaccgggatcagagatatcaggaactgcgtatgaaggtggagtatctgattggaaggtatgacctctcaagcggtgattaccagtatggcctgcgcaatatgaacgcctgtatcgaagcggcaaagatccttaaaaattcgcgctatctgatggacagctatctccagatgatttattatgcgatacaggtttatgacctggatatgatgaaggaatatatcatgtactgctccgagcttttggaggaataccagtactctaaatcaacaccatacacgatacaaaggctcaaggctttgtattacagtaagacggaacagtttgacaaggccgaacagatactggaatcactgattccgaagctggaaaagctgcagatggatccctcctgccagataggcctgatagcctgttataattacaggggagagatatgcatgaagcagggggactgggagactgcgcatacctatataagcaaagcactggccagcagccatgcatcgcagccaacagccggacttgggatgtcatacaccaatatgggaattattttatacagattggataattatgacaaggcttccgagtatttcgacaaagccagatgctgtttccagaatctttccatccagtggggacgcgccaaagaagaggcgtattccgcgctgctggagctgaagctgggcaaaagcaaaagcgcgctggcgcgctacaaagcggcatgcaagtatgcggataaagactacagtcccaatacgctgctcatgctccagaccgtgtacgcccagctgcaggatctgcccggactcgaacctcaggaacctccgaggatccctaagcaggcaaaataatgataatagaaaaagaggaaatccagtcagaaataatccggctgaatttcctctttttctattattatattaccataaaaatgactgtttttcacaatgaacaatcgtgatccggtgatgggtggaaatgcattaaacaggggagagaaacggctgaccggtattgatttgatctatgaatatctgaagataatccggatggaaaagaaattcctggactgttttgatagacaggcggttgtaaacctgatgagcgccatttatccgcagtatcaggaattatatctggataatctgtgcagtccggtgcttttaaatgccctgggctgtctgattgccggaaaaccggttggcagactggaaccgggacggaacggcctgtgtctcatagaaaactatttcacaggttgcggggcagaggagatagagcgtaagctggcaccgtgtatccgtattctgaccggtaatttggaatggtttgacaggtcggcaaggcattatgcgccgcagattgaaaatgcgctcagattcggctgcctggatcggcttttccaggtctaaaaaagggaagagacacctatcacaatatctcttccccatatataatcaccatttttatacagccggcagccgcttatccatctgccggccgctgcatttatcactattaattcaagaggtttttaaaaatataactgttccattgagaaagtatgtgttctcagatagaatttcagaacttcttccagtgcatacaccggaacaggtcctaccagctcacagtcctctacaaggatgccgtactgggatgcttcggatttgattgtctcaaatacacggtgaataggagtcttttcatagtttgtcaggttcatggatacctgtacaatgccgcgctcttccagaggaagcgcgatagcgcgcacgttctggtaaccgcccgcagcgccccttacggctttgacgatctgctttgcgattgcgatatcggcagtctttaagttaacattgaaagcaacgagcgggaaacggacgcctgtaacggttgcgccgctcttggcgttgaaatccttcgggccttcatccggaacccatgcaggatctttcatgcgctcgcagagcgcttcatattcgcccttacggatgcggacaagattttttctctcttcgcatgtagcggcatcttcataataataaacgggaactcccagctcatcgcccaggtatttgccgaaagctcttgcaattacaagcgcttcgtcgatggatacgtcttttacgggaatgaacggaacaacgtcaacggcgccgatacgcggatggcttcccgtatgcttagtcatatcgattaattcgatcgcttttgctgccaggcgctttgtaccatctaagacagcctccgggctccctttgtaagtaaatacggtacggttgtggtttgcattggaattgatgtccatgacatcaactgcttctccgtccagtagagcggcttttacctgctcgaccagatccagatctttgccttcgctgatattgacttcagccattaatactttcattgcttttcctcctgatcttaattcatggtgctttatattaattatttgttacatcataattggcgcatcttaattgttacatcatacctttgccgagatcttccatggcctcttccatctcccgggtcctggcctcgtccttaatcatggacaggttagcctggatgtttaaaacacagccctttactcccgattccgacagatacttggcgctcatgaggtctgaaaggcaggccggattggaagaaccctcgagacggcatacaagctcgtagactctcttattattatagccgttgttttttggaacaagggcagcctggtaagcggcgtcacggacagcctgttttctcacttctttttcttcatcagttgatttgggaagagcgaaagcatccttaatcatacagtaagcttccgtatcctgttcggagccttttaacagtgtttgggccagttcgtccagttcttttgacatggccgtatattcttcctgagtgaggttaaccggttttgccatggagagctttgcaaccatggaagccattccggcagccatagcccccgcaagtgcggaggcagagccgccgccaacggtaaaatcatccgaatcaaccaccttgttaaatacgtctaaatacataaaattcctcctttagccgcaactttaccttttttaataatcgtttcaatcggattacggccatatttataaattaagtcttcgtaagtatcggtgtcgagtatcagcagatcggccagcttgccgggagtcagggaacctctgtcctttaatcccattgctttggcggctccctttgtagcggcgcgcagcgcttcttcagcgctgaaaccatgctgtctgcaggcaagcacaaggatgaaaatcatggattcacaccaacagccggggcagcagttggtagccagtccgagatccatgccgatatccagcatcgggcgcggatcaacctgctttggatgatttaccgcaaaatcggttccaaccagcaatacgcctgtgacatcggcgtcttttagcttctggaacacactgacaggagtataattcagatgatcggcagacagcatatgcatatcggcggccagatcagaacctcctatataggagtaggcgtcggtgtggattctgggggccaggccatagtcacggccggcggccagcacggtttcacattcttttgccgtataatgaccttcatcgcaccagatatcgttgcagacagccagtttttctccggctacccgcgggatcatctctttgcagagcagatcgatgtaatcttcttttttcatgccttccgtccagccatgagcgcccaggaaggtggagaagatatccagaggaagttcttcgttcaattcgcggtttacttccagcatacgcagttcggactccattgtcaggccgtaaccgctcttgccttccagtgtagtggttccgttcatgaacatattttccagacgccgttttgtctgggcctttaactcctctttcgggaggttaattgtcatatttacagaggcgtaaattccggagggaatcccttttttagccagggtttccggattgtcgtcaaccacggaaacggcatacgccgcaacgcgtgaaccgccaaaggttacgtgggtatggcagtcaatgaagccgggcagtactactttgccggttgcatcgatggtttcaacctcggtgccgccggccctcagtccgccggccagtttctcaatatccccggttttaccggctgcttcaatcaaaccgtcccggatcaggacacttccgccttcaatcaggccgatatcattattgtgatcgccttccatggtcaggagctgtctggcgttatggatcaggagaacttttttaccgttgtccatcatggatctcctttcattttaagcataatcaggagggcacataagtacccttatgaaccctcctgccatattgcgttatttgtatattatctgatatattcgccttccggagcaaaggtaactttatcagccggctcccaccacagcggaatcttgatgctttcgccgcctgcgatcttgccgtttccgttgcagacatcttttgcggactggtatccggactgtgcatgacggacaacaccgataccggagtcaacggtcagagcggagtcaagtcttacgtcagcttcttctgtaccatcagcaatcatggtaacacctgtatgtacagcctcacccatggagtagttagcctggatagcgatcaggtcgcagcctgctgcacagtttaataagccgtttaagtatggccagtcggagatgtagtcgccgccatctggcatgttctcggactcgaatgtcgggttaacgatagaaccggagtctaagttatctctggagaatgctaccgggccctttacctcgcctttcttaattaattcgtttactgcaagaccaaaacgtcttctttcgccaaagcccatgtagcagatacgtgccggaagagcctcgatcggaaggtgttttctggccaggttgatccatctctcaaccaggtggtcacccttgcagatttcaagtgccaggtcatccagacgagccaggtcggccgggtcaccggagatacaggtccaacggaacggtccgcggccttcgcagaacagtggtctgatgtatgctgctacgaaaccttcaatctgttttgcttctttttcaggcatacctgcatcgatacactctttacggatgcttgtgccgtactcaaatgcttcaacgccgcgtttcttgaattcgatcatggcgcgtaactgacgctgcattgtctcacgtgctgcttcaaggtaagcttttctgtcttcgcctctgaatttatcagcctcaactcctgtgtatcctgatgggatataggaaatcgggtcatggcaaggacacatttctgtaacaacgtccggaaggaagttcttagcaagagcctcttcataaacatctgctgcgtttccgacaacaccgatggagattggctcatctttctcaagatgctctttagcgatagcgatagcttcatctaagcttctgaccatcatatccatgtagttcttctcaatacgtctctggataactctctcatcagcgtcaaccaggataactaccgcaccgtgcatcttgccggcccatgtctggtttccgcccatgccgcctgcaccggctgttaagaaaatcttgccgtgcatgtcattatcccactcttttttaagagcgatagcggacagagtctcgaatgttccttcgataacgccctgtgttccgatgtactcccatggagcagccgtgtactgagcgaagattgtaaggtttttatcctgaaggtcgtagaaacgctcccagtcagctttcataatattagtagtagccataacaacacgtggagctaatttgtgtgttctgaaaactgcaacaggcataccggactggataaccagtgtctcattatcttcaaggtcttttaaggactgaacgattgcatggtaggattcccagtttcttgcgcattttccgtttccgccatagataaccagctgctctggaatctcagcattttccatattgttctcaagcattcttaagatggtttcctgtttccagcccttacatcttaattcgccacctctttgagcttttacggaataatagatttccggttttccttcctttgctggatacatgtttccgccgttcattgacataactaaattcctccatttctttttgtttgcttttttctttgtttttctctacaccctatgtagtattgttttttgccgttccgatattggcatttcggaagtggcgtttgtttgtatctgatggttcaagtatatgtacaggcagtcgaggaaatgtcgatgtttcccgtaaaataacaggatgttaaatttttttttggaaagcttatatcgacactttctcggcggaacgtaaatatacttgtcatagtttttgtttagaaactggaattacactgtaacaaaaggacataatcgaattctctttaagaaatcacaggcaataagatgttttacaggagtttaaaaagaatagtagaacattaaagattcagtgatctattgggagtaaggatggaaagcgggggatgctgaaagcgggagagaaaaagaaatactattatattagagggctttatgctaataaagtattaaacagtaaggtgtttctctgtatttaagatgaatggggaaacggctccggctgcacggctgcatattacaggcaacacgtgcggcaacggtaaacatgaaatctgtttacgggggccagtatgttagttaggaggcttaaaaatggaagacttattaaaagaggcgcaggaactgcagcacaagattgtagagtggagaagaatacttcaccgctatccggaaacggggttagtgcttccaaagacagcagattttgttacaaaacagttaacagcggcaggcattgcttacaagacttataagaaccattcaggaataacggctgtgattggcaagggtgaggggaaaacaattgcgatcagggccgatatggacggacttcccataaaggaagagactggtcttacatatgcttctgcaaatgagaatatgcacgcctgcggccatgacgctcatacggcgatgctcattgcgacagcagtgatgctgaagaaccatgaggatgagcttaagggaaaggtaaaacttattttccagccggcggaagaaggccccggcggagcagagccgatggtgaaggatggagtaattgatgatgtggacgcgattctggcgctgcatgtgggcacgatgttcggaccgttcaataacggggacatttgtgtgagctattccaacactacggcggccgacgatcaggtgctgatcaatattaccggttttggaggacacggctccgttcctcatgaatgtattgatccggttgccatcgcagcgcttatcatcaacaatattcaatatattatcagccgcgaagtggccccggccgaatctgcggttattactctggccagtgtggaggcaggaagaggagcgtataatatcattcctgagacagcagttgtaaaaggaacgattcgcaacggttctcctgtggtaagggagtttgtcttgaaacgtattgaggaaattgcaacatcgacagcccgtatgatgaggggaaattgtacggttcagatactggatggctatccggcgcttgtcaatgatcgctcagtagtggagagcttcctgaaatctgcaagaaaactgattccggaagaagagattcatatcgccagccatggaatgatgggtggagaagatgcggcgtttttcttccaggaaataccgggatgttattttttcctgacaaatggtgcggcgtgcccggctgacggcaaacagtatggggcgcatcatccaaaattctgtcttgatgaagatgtcttttacaggggaccggcattattcacccaggctgcaatggattggctggaagataacaggtaaaaaataaataaggggatgtttcgattatgtatttggatgcaatattttattttatggtaattctggccataatggctgtcgccgatattatttcgacagcaacaagagccatgataccttcgatgttttcaatttctgtaatatgtattgtactgttttggagcggcctgcttcctccggatgttctggagctggccggtatcagttcgacgctcgtgtatgtaatctactatctgcagcttcctcatatgggggctcttatgagcatgagggaaatggcagttcagtggaaaacaattgtgatttgtctggccggtctggtgggaatgtgtattctcaacgtaacagtcggcacattattattaggtaaactggttgtgctggccggaacacctccgctgagcggcggtatcgtagcttatatgattgtaagtgagcaggcaaacgcaatggggcgcccggatttatccactctggctttggcagtattcgtattacagagcttcgttgggtatccgcttaccgctttcttccttaaaaaagaagcaaattatcttctgaaaaactacagaaatggtattgtggaaggcgaaaaagaagctattaacagcagcaagaagccgcttattcctcagcttccggagaaatacaatacaacaaacacagttcttttcaaagttgcggttgccggtgtaatcggtattcttattacaattgcaaccagagagttcctgtcccggtatgtaattcttctgattgtgggcgttattctttcggaaatcggattcctggatcgctcaccgcttattaagtcacaggtatttggattctcaatggtagttattattggttatgttgtagttgcaggtatcggcggaacaacaccggacgtagtcctttcctcactgattcctacggttggcgttatcgtgatcggaacaatcggtctggcagtcggggcaatgattgccggaaagctgctgggattcaggaaagaaatggccatctcggtcgctttgacggctctttacgggtatcctggaacttatatcctgtcccaggaaagcgttaaggctgtcagtgacgatgaaacagagaaagaatatctgaggtccagaattgagcctaagatgatcgttggcggttttaccacagtaacatttgcatccgtatttgttgcaagtattctggtgaaattcttctaaacagtctgtccgttttgatgaacggaaagcttattatttaaataaaaccatgtctgggccgcggccttcacatccggaattgtgcctccggttgagaagaccgcggcctttccaattttaaggacagagaatatgcctgagtctattggaataactatggaagaatgtgtcgaaagaataaagcggaatttcagcgaaaaatacctcaagccgtcgaaagaggggagatgaaagataaagtcatccgttgtaaattcaaaaactctgtgatacactgaaattgtctgattatctgtgcaaacagagtaataatatgacgggagacggaaatatgacggtagaaaaagagataaatacagagaaaaataatgatatgctgacaggacatccgggacggagcctgttgttttttgctttgcctatgatactgggcaatctgtttcaacagttttataatatagtggattcggttgttgtggggaaatttgtcagtgaagaagcgctggcttccgtcggagcatcgtatgcgatcaccaatgtgtttattgcagttgccataggcggaggcgtcggcagcgcagtcattatatcgcagtttttgggcgcggggagagccggtaagatgaagaccgctgtctccacaacattgattaacttcctgatcatcagcatgcttctggggacggtgggactgatcggaaacgactggatactgcggcttctcaaggtaccggagaatgtgttccgggatgcggcggcatatctgagaatctattttctggggctgccattcttgtttatgtacaatgtacaagcctctgtattcaattcccttggggattcacgcacgcccctgtacctgctgattttctcatccctgctgaatattttcctggatttggtgtttgtgatacaattcggcctgggcgtaaaaggagttgcttttgccactttgattgcacagggaatttcagccgtcatttcctttgtccttctgctccggaaagtaaagaaatatcctcatgagcgctcagaatttcatttctatgacggaaagatgctgcgttccatgacacgggtggcgattccgtcgattttacagcagtcgattgttcatatgggaatcctgctggtacagtcggtcgttaataccttcggctccgccgttatggcaggttactccgcggggaccaggattgagtcgctggcaattgttcctatgaccgcggtcggcaatgcgatgtccacattcacagcccaaaatatgggggcaggcaatgtaaaacgcgttaaggaggggtataggttctgttatattatactgggctgttttgcagtcctgctttgcggttccatccagttgttcggacactcctttgtctccgcatttctggatgcggatgccagcagggcggcatttgaaacaggaatctcatacacggatttcatttcctttttctttatttttatcggcctaaagatgaccaccgacgggctgctgcgcggcgccggcgatgtgacggcctttaccgtcgccaatctggcgaatttaagtatcagagtgtttgttgccaactatttcgccccacggtacggagtacagtttgtctggtatgcagttccgataggatgggcggttaattatattatctcctttacctggtacttgacgggaaggtggagccggatcaggctggttgggaagaaagcagaaacataacagaaacaatagcagaaagacaggaggtacaggatgaaagagaaatcgtatatgcttgctttgccgggggagcaggaaccggagggtagaatggaggttctcaggaggcttaaaaatgctcctgactttaaggtggtcactgctgatacggaggatgaagggagccttgagcttacagttgaatataagggaaacaggtacagggcgctgctgtatccgaccggatttgaactgccggagttctaccgatgccagcatttgtttcccgacgtggatattgaagtaatggagagggcagagagcggactggcagtggagatgatgtttggagaagatgcgctggactcttatcaccttcagcttaagctgattcatgccgttcttcccgatgccgtggcagttctcgacgacagctcggaaaagatactgtcgggacattgggttgccctggccgctgtctcgtccgttcccccggcgccccgctacatttatacggcgcaggcggtatcaggggaggaagagatcgtctggctccatacccacggcctgaaccgctgcggcatatcggagctggaagtgctgaattccacgaaggatacatataacagccattacaatgtcctggaaacaatggcaaaccggcttctggagctggaagaaccgctggagccggaggagcccctgtatcttgcacgcctgactgaccgggcggctctggttacgacgctggttccctggaaagaagccgtggaattgtatgacgatgatatgctgggaggaaagggtgacagggccgaggggcataacggcaatacaagcgtgatatttacctatccgtccaaagccgattatgaggaaggcaactattcgccgctttcccactatgatgaaattctcggaaataatccaatctactggatatccacgccggagacggaacggatgaaggcgctggccgtcgaacgcgtttcctatatgctgcgcgccatggaggttaaggagaatcatatcctggtgaaggttggcctgactatagacgaggaatatcaggaggacaacaatacgaaggaacatatctggtttgaactgctaaaggcgcaggacggtaaattcactgcaaagctgacgcaggaaccatattatgtcagcggaatgcatcaggatgatatcggaacgtatacatacgatgatttgacggattggatcatatttacgccggaacggagaattacgccggacgatgtgtatattatggatttgtaattttgtttaattaagcagatgaggacgccgccgggacggccgctgattgtctcatgcgttaagtgcggggtggaatttgttgcggcggctaagtgtttccgtgtattaaaggtattattggagtggagtggactttttgttattggaaaagaggtgtggaatggttgagattagacctgttattatggaacaagagaagtattttcccctgttgcaggagattgaacccagtggggagatggttgaacggaatctcagagagggggaattctacctcctggaagcagagcgggaggcagtctgtgcggcggttattatccctctttccgacaataccggcgagattaagtacctggcgacgcggcaggatttgcggggcaggggatatgccggacttctggtaaactggctgtgtgggcggtatacccagacttttacagccatgaaggcggaagtttccggcagcagactatccttttttcagaaattaggctttaccgtctgcaccgatgacaaaaatccttctcatacatattgtctgtgccgtgaacttccggtgggagaggacaggcctgaggggacgctgcgctgtgggcaggcggagatcggaacgcctgcttatcaaagtactttagagcttcggcaacgggtgatgcgtcttccgcttggactggatctctatcagggtgatatgagccgggaggaagaatttgtccattttgcggcgatggatgaaaaagacagggcatggggcgtggtggtggccgatctgaggcccgacagaactgtggaagtccgggcagcagcggtagacttgcggatccagcggtcaggctgcgggcgaaggctaatgacgatgatggaagactattgccgcagccgggtgatgaaagaaataatcctccattcacggaaaacggctgccggcttctacgaacaactgggatacaccagaacacccggagaatttatagaggtcacaattcctcattgtgaaatgcgtaaaatattataaattaaaaaagtctgcggaaaataaaaattccgcaggcttttttacgttgaaggcggtggaccgtgcgcggggcgtgcaggttatcgttatcggaaatttgcggcgggctgaaaggctcataattccgtctcaccaccccgtccgctggccgtcccggcggcgtcttcccctgcttaattcatcgaaatgcctccggcgccaatttcatcatatcttccgggattctcccctgctccctttcaacaacctcatataccacaacatcgggccggttctctttcagcagggaggcgtcaaacgcctgccagtggtagtaatccgtataccggaagtatttactcaatgtctgtgacagcgaatagccgaaggagtcccggtaaaccgcaatgcgcctgggatccggggcatccggtgtcacctgatgggtaatgttgccgtctccgttcacatcctcccgtgttgtgctgagttcgtcataatagccgctgatcactgccattgtgtcatcggtgcgggaggggggcatatggaataattttcccaaatcacctacgccggaaggaaggtaggataccgtcacatcctcgattgggacaggtgctccgcccagggcttcgataagcatctggtttgtcacgtaaccggcggcatcgttccagtgggtgtcggtcttgaaataccactggtaatcccggttttcggcaaaatagggggccggatcgatgacggtcaccgtactgtgcgttctgatataggaaatcagttcctccgaccgggtaggggaggcaagctgcctgcagctgtccgggagatattccctgtaaaccgactccttgctgggagggagaacaaggataaactgaatgccctgagattcgaagtagtcggcagccgtctggatatgcgcggttatggcctgaagcacaggctcgggatagcggttgattccgaggcagtcggccagggaggaaccggcagtatagaagtaccagccgtcctttcccttcaggacttctgtggaatccgggtagtcaaacaaatccaggttcagccgggcattcagggagagaaaacggtttcggaaagcggcgtgatcattgatgtagctgtccatctcgccgggatagctctccaatgtctggaggctcaaatgaggaaagtctgccagcgcccggttttcatccgttcctgtatccgactcgttcttcataaatggatagagcaggttaggggccagaaggcacagccagaacccggcaatcataattattttcttattcataaagtaaaactccttaaatcagaactgaaaatagataaatgcggtgtaggtactgctgacaacgaccatggttgacaggaacaaaagcacaatcatcactgcaatatcgccgtaggatacgttttcttcatcaaatatatggttacggaacctgggaaacagggcctggaccgggccgcataagaggattcccaaaacggcgaggaacaggattttattatttgcgaacagtcctgcattccatagccctttagaaggccttatcatcgcctttgccaaatcgatggcgtacgtcatgctgggtgcgcgaaacagcagccagccaaagacgacgacaaccatggcgtacagatgattcaaaaatttaaccgggttgcgatccagcacttttttcagccacaaacgttcggagaggatgaaaaggccgtgatagattccccatataatgaatgtcatactggcaccgtgccacaatccggttgccaggaatacgataaaaagattaacacaggtccggccaaggccttttctgtttcctccgagagggatataaagataatccctgaaccaggttgacagggaaatatgccaccgcctccagaattcggtgatggaggaggagaggtacgggtaattaaagttttcttcataataaaagccaaagattcggccaaggccgatcgccatatcggaataacccgaaaaatcgtagtaaatctgcaaggtatacaggattacggccagccaggcggtaagagtccccatctggccggagggaacgcccatgatataatcgacgctctgcccgaaggtgttggccagcagcactttctttgcaagcccgtatacaaaacgtttaattccataaaactgcatggaaatggtttcgttccggtttgtgagctgtccggcgacttgatggtattttataatcggtccggaaagaatctgcgggaataaaaagaggtagagagccatgtggaacaggtttttctgtgcagggctttttccgcggtagacatccacaacataggagattgcctggaaggtgtaaaatgagattccaagcggaagaacgatgtcgcgcagagggaacagctcttttcccgcaagacggccggctgtcgccgcaaagaagttatagtacttaaaatacccgaggattccaagggtaatcaggacaaaaacccccaccgacagcttctttagcgcggtccgctccccggcagcgtcgagacagagcccggcagcgtagcataagagcgcggtcagcagcactaaaagcagataacgcggtccgccccatccatagaagatgaggctggccgcgaaaaggacaatattttttgcgttccgtccgggagccagataataaagaaaaacggctgccggcaggaaaaaccataaaaacacaagggaactgaataacataattgtaccgccttttaaagattgtaatagttcatgctgtatgaactgttactaaagattagcctttttcacgtcaaaagacaactgaaccttgaacagatcgccgtcaatatagatttcgaaccggccgttctgaagctcggtcaggcttttggcaattgacaggccaagtccgcttccctccgtggttctggcaacatcgccgcgcacaaagcgttccgtcagctcgtcgccgcggatattcagtgggttggccgagacattcttaatcgtgaagacaacctgcgcaggaagaaggagtccctcctcgctgacggagatatctgtttttgtgatatcgatataaatacggctgctctccatcgcatatttaaatgcgttattataaaggttttccaggacacgccagagcctgcggccatctgcctcaatcaggagagtttcctccggggcggtggtgataagctcaagatgtcggctggcaaatttctcttcaaattcaccgttggtctggtaaaccaactgggtaaaattgatgtcgcttatttcgagtttcaggtttccggagctggctttggatgcttccaccaaatcctccgtcagggttttcaggcggttggctttctgctccaacacatccaggtagcggagaatcttctcatcctgaatattttcacgccgtatcagccctacataattaataatcgaagtaagcggcgtcttaatatcatgggaaacattggtaatcagatctgtcttcaggcgttcgctttttactttctcctgaagagctgtttccagtcccatactgatattgttgatgttggcagccagctcgtattcttttccgtcaaaatcatccaggtttacctgatagcttgtctcaccggcagacagatgttcaattgccgtactgatcatgtcatgctcaacggaatgcttgaacataagatagaatatccacaggttgaaggccgcgcaggcaaggattaccataccggtaagggcgtaaaccgccgtcttgctcagatagattctgtcccataaaaaccaggcaaggctgatcagagaggtgttaatggccgcataggccaggaagctgacagtcaggcgggttgtaaaactctggcctgtaaagaatatggacagatgttcgctccagcggcagacaaagctgccggtccatatggttcctgccttataccgtctcagcatgctgaaaaacaaaagcagggctcccagataaaagacggcggtgtagagaacacgctcggacagcgcccaggattcctccggcagaaccagatgcgcaattctgacaagcaccaggcggcagagtattaagccggccagcgtcatcagggaaaacatgacaatacccgtctccgtgcttgtcttgtcaaaaccgtgaagcgtaatcgtcttgtctccgacattcctgtgacccgataccttaagcaggaacaggagcgtgaggaccgcaatcatacctccggtcacaagaaggacaaaaccgctgatataataatgctgcatgctcaaataagcgtcccggttttccgagtagacatccacaaccggataagaggtatccacaccggcaaggaggtaaaatgttttagtatcataaggattattagccgccagtgcggaaaccgtatttaacgcaattgacttcaggtttgtatcatagaatacggaatttcccggaaggtatgcgtatttcccgtaggttttaattacatcgggcgtcagttcctggtcattggcaaaaatagtggctctcttggtgctggattcctgatcaatatattccactttaaaatgcagattgctcggatttgcaagcaggcggttgtaggtggaataatactgatggagtgattccataatttccagggagacatcttccagagtcgctctgcgcgttcccggaatcaggtagctgtaattttttttaggctcgcttgcggaccagtcaatatatccctcgcgtgttttagcctcaagggcgggagctgataccttgttacactgaaaatcttcatttaactgataccccatggtctggagataggaaatgatgtcagccaggctgaagctctccgtctcgtttggaccgaaggtcatctgaagcatcttctttgagacgtcgattgcgccgccgctctcaaaggtgggattgtattctatatattggaagatatcattcaaatccctgttaaactgacgggtaaattcgtcggtatcctcatagaccgtattctggactcgggtgataccgatgccgaagttatcgttcagatacatggtgccgatacctgcgaacatcactgtcagaaagattaggtgcagggcgctggcaatcagtttttgagcctgcatggatagccgagaaaatttcatattatcacctgttctgtattataactactgtttctcaattttatagccgactccccatacaaccttgagatacctgggttctctcggattaatctcaattttttcccggatatggcggatatggacggcaaccgtattgtcggcgccgatcgcctcctcattccagatttcctcgtaaatctgatcaatggagaatacttttcctgcattccggacgagaagcagcaggatattgtattcgatgggagtcagtttaatcagttctccatccaccgtaacttccttgttttcatcgttgatcaggagacctccacatttaaagatatgtccgcccgcctgggtattcatattgccaagctgcgtatagcggcgaagctgggatttcaccctggctaccagttccagcggattaaacggctttgttatgtaatcgtccgcaccgatattcaatcccaggattttatcggcgtcctcggatttggcagataaaatgataatcgggatactgctggtttcgcggactttgagcgtcgtgcggataccatccagtcccggcatcatcacatctataatcatcaggttcacactgtggttctgcaaaagctccagagcctcgaatccatcgtaggccttaattacttcaaacccttcacctgtcaggtaaatatctatggcttccacaatctgtttatcatcatcacaaacgagtatactctgcatggctgaccctccttataggcacacttttcttcattatacaacggattagagaaaaaaggatattactttttccttaaatggagatttaactgaggttgggaggacgcgtccggaacggaccatgtccggtgtggtgagggggatgactgagtcttctgtccccgtgggaggttagtcgtggagggggaatccggccggaatgaattcttacggggaccgtttgcactcttcgaagcgcatagccgtgctaaattcgaaaaaacctcattaagcacggatgggcttccatgtcccctccagaattgattccgcctacttccccggtccaggttttcatcggggacggaagactcaggcgcaggtcttcgcgacgccggacatggtccgttccggccgctgattgtctccaaccttaaatggggatggccttgtcgcggccactgcgtgtttccggcaggcagatatcaaatctagcgccttttataaaggcgcaatgaaggcatatcgtatttcccgcacacggaagctcttagtggcgcgacaaggtccgccctccgcacttaacgcgtgagacaatcagcggccgcaggccggcggacggggccgatacacccggcggagtctttcgtcccggcgaaaacctggccttggggcggaggggaagataaagtctgcggatgccattgaaattcatcgctgattagcgaggtcctgccgagcttagcagcgcgatgcatttcatagagcgggagcgtgctccgcagactttatcttcgcccgcagccccaaaccacaacaattctcccccgggacgaaagactcatatacacaccccaccaccccgtccgctggctgtaccggcggcgtcctcacctgcttaactaaatcccgtggcaaaatggcgaaattccgcgaaaagttattcttgacaaaaagagggagattcgatacactgtgaatagtttgaatatcaaaacatttgaaaccaaaagtaataatcggggataaaatatgacttcaagaataatcggaatcggctcctatttgccggaaaacattgtgacgaatacagatttaacagaatttattgataccagcgacgagtggattcgcgaaagaagcggtatctgtgcccgccgcatctctacggaagagggtacatcagccctggcggtcaaggctgcaaagagggcgattgaggatgcggggattgccccggaggaaattgagattatcgtgctggcgacttcttcaccggacagggcttttccaagcgccgccacagatgtacaggcggctgtcggggccttgaatgcggttgcctttgatattaccgccgcctgctccggatttatctacggcatgcatattgtgcagggctttatcaagtccggaatctataagacagggcttgtaatcggcgcggagacgctgggcaaggtcctggactggacggaccgcggcacctgtttcctttttggcgacggcgccggtgcagctgttgtgagagctgatgagagaggattgattgacacgctggtaggcagcgacggcagaaagggctgggtgcttgactgccaggccagaagccttggcaattgtctgacaaagacgaaaccggaactgggatttatgcagatggacggccaggaggttttcaaatttgcagtccgcaaggtgccggaaatcactaaaaaaattatggaagataatggagtgtcacaggaagatatccgctacttcgttcttcatcaggccaattacagaattctggaggcagtgtccagacgtctaaacattccaatggagaaaataccggttaacctggatcaatacggcaacacttccgcagcatccatccctgtactgctggatgaaatgcacagggacggccggctggaacgcggcgacaggattgtgctgtcgggattcggagccggactcacctggggggccatgcttctcgaatggtaacgcagaaacttctgccataagattgacaaaaagccgcagaccgggcattatggacagtggctttgtatataaaagcaaatctaaaattaaaaaatagtaaaaggagacaaggattatgttagagagaatgaaagagatgattgcagaccagttaagcgtagaggcagagattattacagaggcctcttccttcaaagatgacctaggagcagattccctggatctttttgaattagtaatggctctggaagacgagtattctgtggaaattccggcagaagacttacagaatcttttaactgtaggcgacgtaatgaattacttaaaagaaaaaggtgttgaagcataatgaagacaagagtaacagcactcttagggattgaatatccaatcatccagggcggtatggcctgggtggcagaacataatctggcggcggcagtatcagaggcgggcggtctcggtcttattggaggcgccaacgctccgggtgaagtggtgcgcgaagagattaggaaagccagagaactgacggataagccgtttggtgtaaacgtcatgttaatgagtccttttgccgacgatgtggcgaaggtagttgtggaagagggaatcaaggttgtcacaaccggggcaggcaatccgggcaaatacatggaaatgtggaaaaacgcaggaatcaaggtcatccctgtagtcgcctccgtagcccttgccagaatgatggaaaagggcggagccgatgccgtagtggcagagggaacagaatccggaggccacatcggcgatcagacgacgatgagcctggtcccccaggttgcggacgccgtttccataccggtaattgcagccggaggaatcgcagacggaagaggaattgcagccgctttcatgctgggagccgaggcagtacagatggggacccgctttgtagtggcgaaggagtccattgtacatcagaattacaaagacagaattatcaaggcgaaagacatcgattccgcggtaacgggacgcagccacggccatcccatcagaagtctgaggaatcagatgacgagagaatatctcaagatggagcaggaaggcagaccgtttgaggaactggaatacctgaccatgggcactctcagaaaagcagtcatggagggtgatgtcatgcacggaaccgttatggccggccagatcgcgggtatggtaaagaaagaacagacctgtaaagagatgatcagtgagatgacggctgaagctgagaagctcctgtcaggaacttccttccgttagtaaaatagcggtgaagagctgggataacggcttttcaccgttcaattaaataatgaagaaatacgaatcagaatgatacagcaggaattaaaagatagaagttaggataagttgggagcgaggtaacgctatgagcaaaattgcatttattttcccgggccagggagcacagatatgcggtatgggccaggacttttatgagcagactgagacggcaaaagagatttttgacaaggcatccgaaatactcgggttctccatgccggaactctgttttgagaagaatgacagactggatatcactgagtacacacagccggccatggttacggccagcatcgcaatgatgaaggttttcatggagcgcacggggattactccttcagtggcagccggtttaagtctgggggaatatcctgcaatggcggcagcaggcgttatgtcggctgaagatgcaatacggaccgtaaggcagaggggaatcctgatgcaggaggctgtcccggccggagtcggagcgatgtcggccgtgctggctatggacggagagaagattgaagaggtgattgcaccgattgacggtgtacagattgccaactacaattgtccggggcagattgtaatatccggcaaaaaagaggcggtcgatgaggctgccgtgaaattaaaagaggcgggcgccaagagggtgcttccgttaaatgtaagcgggccgttccactccagtctgctcgaggaagcaggagagaagctgggcgaggtgctggcacaggtggaagtacataccccggttattccttatatcgccaatgtgacggcgggatatgtgaccgatgcaggtgatgtaaagcctctccttatcaaacaggtatcctcctccgtacgctgggaacagagcatccgcaggatgctggaagacggagtggacacatttattgaaatcggcccgggcaggacactgaccggtttcatgaagaagattgaccgaaacgcgaaagcgatgaatatagaaaagctggaagatattgagaaagtgaaggaggcgttaggatgttaaatgataagattgcagtcgtgacaggcgccagccggggaatcggcaggcagatagctcttaccatggctaaggaaggcgcagccgtgattgtaaattataacggttcagccgccggtgcagaagcagttgtgaaggaaatctgcgaggccggaggccaggctgaggcggtgcagtgcaacgtatccgactatgcgaaggcagaggaatttctcaaatatgtgatcggcaaatataagaggattgacatccttgtaaacaatgcgggaattacgaaagacaacctgctgatgaagatgagtgaagaagaattcgacgcggtaatcgacatcaatttaaaaggcacattcaactgtatcaaacatgtatcacgccagatgctcaaacagaggggcggacggattatcaatatctcctccgtatccggagtgatgggaaatgcaggccaggcaaattactgtgcatccaaagcaggcattattgggctgaccaaagcggtggcaagggaactgggcagccgcgggattacggtgaatgcaattgcccccggctttatcgacacggagatgacagcagtgcttccggacagcgtaaaagaagcgatgggagagcagattccgttaaagagatttggcaggacggaagatgtggcggatatggcggcttatcttgcatcagataaagcaggttatatcacgggccaggtgatctgtgtggacggcggaatggcgatgtaaggcagagctgtgacaaggcggaagtataaatatattaagaagaaaggcgaatgcgctatgaataataatacaagagtagtcgtaacaggaatgggtgctgtcaccccgatcggcaatgatgtagaaaccttctgggaagggctgaaggccggaaaaaaaggttttggaccgattacttatttcgatacaagtgattttaagtcgaaaatcgcggctcaggtgaaagactttaacgcgaaagaatacatggatccgaaggcagcccgcagaatggagacattttcccagtatgcggtggcggccgcttcccaggccctggctcagtccggcattgatatggatcaagaggatccgtataaggttgggatcagcatcggctccggtatcggcagccttcaggcaattgaaagagaatatacgaaaatgaaagacaaagggccgggccgcgtcaatccgctgctggttccgctgatgatcagcaatatggcgacgggcaacgtatccattcagttcggtttaaagggcaagagcatcaatgtggtgacggcctgcgcgacgggaacccattccatcggagaggcgttccgggctatccagcacggtgaagccgacgtcatggttgcgggcggcgccgaggcatgtatcacacctctgggcgtagccggattcacggctttgacggctctttcaggcaatgaggatcctgagacggcttccagacccttcgacaaagaccgcgacggctttgtaatgggagaaggttccggcgttgtggttcttgaatctctggagcatgcgcagaacagaggcgcaaagattcttgcggagcttgtgggatacggcgctaccagcgatgcctaccatatcacatccccggcggaagacggaagcggagcggctaaagcaatggaatttgcgatgaacgatgccgggattgtgccggagcagattgactatgtaaatgcccacggaaccagcacccaccacaatgacctttttgagacaatggccatcaagctggcgctgggcgagcacgcatataaagtgaagatcaactccacaaaatccatgataggccatcttctgggcgcagcgggcggcgtggaattcattacctgcgtaaaatccgttatgaatgattttgtccacgctacggtcggcttaaaagagccgggcgagggctgcgatctggattacacaatgggtgaaggcgtatccacaccggtaaattatgctgccagcaattctctgggattcggcggacataatgccactttgattgtaaagaaatttgaagcataggatgttacttaatgttactattcacggcctatatcccgcgaggtgttttcgtgcgtattttgcgcgaaaatcccgagttacacggcgcgaaactgcgttttttgcagtttctgtgcatcgcggagcgtgttacggttcgcggaactgcttttttcagcagggccgtgaatagtaactacttaattgctgttcgcagaaccgtatccgaacggttacaaagaatcagaaatagaatgaggttcaatatggaaataaacgatatcttaaaattaatagaagcagtttccgagcatggtcttaccagctttgtcctggaggagaacggttccaaaatctctatgaaaaaggaaaaggaagtaataaccgttacggcggccccggcggtgcagacggtaattgcgcccgcggcggccgatgcccgggatatttccggcacagcgtcttccgtcccggcaggttatatggcgcctgcagtttctgcggcgggaacagaaatgtcacgctcagagtccatcggatccgataaggtagtgacctctccgctggtaggaaccttttataatgctgcgtcacctgattcagacgcattcgtatcggtcggcgatacggttaaaaagggccaggttctcgggatcatcgaggcgatgaagctgatgaatgagatagagagtgagtacgacggagtggttgaggcggttctcgtaaataatgaggaggtcgtagagtacggccagccgttattccgaatcagataatcggcggacagacaatagccggaaagaaggtagaatatgttaggaatcaaggaaattcaggagattattccgcaccgccatccgttccttctcatcgattgcatcgaggaggtaacgcccggagagggagcggttggatataaatcagttacttacaacgagccgttttttgccggccactttccgcaggagccggttatgccgggcgtgctgattgtggaggccctggcacaggtcggtgcagttgctatcctgagccaggaagaaaataaaggcaaggttgcctatttcggggctattaacagcgccaaattcaagaaaaaagtggttcccggcgataagcttcggctggaatgccatattatcaaacgcaagggaccggtcggaatcggaagtgcgaccgcgacggtagacggtaaggttgccgtaatagcagaattaacatttatgattggataggtgaaggccgatgtttaacaagattttgattgcaaaccggggagagatcgcagtgcgtatcatccgggcgtgcagagaaatgggaatagaaacggtagccgtttattcggaagccgacagggattcgcttcacacgcttctggcggatgaggccatctgtatcggaccggcgccgtccacggagagttatctggatatggagcgcattatctccgccacggtagcgatgaaagcggatgccatacatccgggattcggctttctctcagagaacgccaggtttgcagagctttgtgcaaaatgcaacatcaaatttatcggaccttcggcagatatcattaataagatgggcaataagtcggaagccaggaagacgatgatggaggccggggttccggttgtaccgggcagcaaggagcctgtttatactgcaaaagaagcccttgtgcttgcacagtccgtcggatttccggttatgattaaagcatcctccggcggcggcggaaagggaatgaggatttcccggggcgcggaggattttgaagcgaactttaaccaggcccagatggaatccgtcaagggattttcggacgatacgatgtacattgaaaagtatattgagcagccgaggcatatcgaattccagatattggccgattcatacggaaatgtggttcatctgggggagcgcgactgctctatccagagaaggcatcagaaggttctggaggaatcgccgtcagtcgccatttcggatgatttgagaagacgcatgggcgagacagccgttaaagcggccaaagcagtgggttatgtcaatgccggaaccatcgaatttctgctggataaaaataaagagttctattttatggagatgaatacccgtatccaggtagagcatccggttacggaggctgtcacggatatggacttgataaaggagcagattaagattgcagcgggcgaggcgctttcctttacccaggaagatgtggtaatcaggggccatgccatcgaatgccgaattaatgcggagaatccgggaaagaactttatgccgtgtcctggccgcattatcaacgtccatgtgccgggcggcaggggagtcagaattgacactgcgatttataatgactacaaagttccgccgaattatgattccatgcttttaaagcttattgtccatgataaagacagggagtctgccattgcgaagatgcgcagcgcccttggagagctggtgattgaaggaatcgaaacaaatctggatttccagtatgagattctgagcaatgaagcatatcagaaagggaaaattgacacggactttatcccgaaatatttcccgcagtattgtaagtaaatagtaatggtaaataaccatcagttccgtctaagaaggggagagtgcctatgttaagagatatgtttaagaaaacgtataccttaatcgatacgaaatatgcagacaaggctgaggacagccggtcggaaaacggggaagaacccaatgtcccgaagggattatggcgcaaatgcaacaaatgcggccgcccaatctacacagaggatgttaaaaataattattatgtctgcccgaagtgcagcggctacttccgtatccatgcatacagacgtattgaaatgctcatagacgagggtaccttcgaggaatgggataaagagatggagtttgtaaatcctctcgctttccccggatatgagaaaaaaatcagtgcagtgaaagaaaaatcaggcatggatgaggcggttgtgacaggccgcggcaaaatctacggacaggatgcggtaattgcagtctgtgattccaggttcctgatgagcagcatggggcataatgtgggagagaagattgcaagagccgtggagcgtgcaacctgtgagagactgccggttgtcatatttgctgcgtccggcggggccagaatgcaggaagggcttgtttccctgatgcagatggcaaagacctccgcagccctcaagcgacatcacgaggccggccagctctatgtgagcgtcctgaccgatccgacgacaggaggcgtcaccgccagctttgcaatgctgggcgacattatactggctgagccgggcgctttgattggatttgccggcccgagggtaattgagcagacgatccgccagaagctgccggaaggcttccagagggcggagttccttctggagcatggttttgttgatcggattgtggagcgtaaagatcagaaagaggtaatcgcacggattctcagaatgcataatgggaagaagagctggcaaaaagagatggacgaagcggatcgcatgcgtgaaactgcggccagggtctgtgccagggaagcggccggacttgcaggggggaaaccccgcggcccgattgcgccgttttcaggtgagatgagagtaaagacgctgaataagatagctgacaggcagcaggaggcctgggatacggtacttcagtcgagaagcggtgaccgtcttgtgtccagtgattacatccgagtcttatttgataattttatggagatgcacggcgaccgctactatggagatgacggtgcagtgatcggcggaattgccaccttttacgggatgccggttacggtcatcggccaggaaaagggaaaaacgaccaaagataatttaaaatgcaacttcggcatgccgtcaccggaaggctacagaaaggccctccgcctgatgaaacaggcggaaaagttcaaccgtccggttatctgttttgtagacacgccgggagccttctgcggactggaagccgaggagagaggacagggggaggccatcgccagaaacctgtttgagatgtccgacttaaaggttccgattctgacgattgtaatcggggaaggcggaagcggcggcgctcttgcccttgcagtggcaaatgaggtttggatgatggaaaattccgtctattccgtcctgtcgccggaaggatttgcctccatcttgtggaaggacagcaagagggccagtgaagcggcaaaagtgatgaagatgacggcaaaagacctctatgagctgggactgattgaacggattattgccgaggatctgccggctacggcggagaccgcggaaatagtcggagaaattattgaccgccatatgagagagttctttaagacctgcgaaatcatgacgccggaagagattgtcagccagagatatgacaggttcaggggattttaataatagttaaaaacaggataggagaaatagaatgtgtaatttaaaaccgttgaaaataggcaatctgaccgccaagcttcctattattcagggagggatgggcgtcggaatcagtctctcttccctggccggggccgtagcgaaagaaggcggaatcggtatcatatcaacggcgcagattggttttcgggagccggattttgctgaggattcccagacggccaatttaagggctatcgggaaggaatttaaaaaggcaagggagatttcaccggacggtgtgatcggatttaatattatggtggctacccgcaattatgcggagtatgttaaggcagcggtgaaggccggagccgatttgattatctccggggccggtctgcccattaaccttcctgaatacgtgaaaggatcggctacgaaaatagcaccaatcgtttcttctgtaaaatcagcgatggtaatctgtaagatgtgggacagaaaatataagacagcgccggatctggtagtcgtagagggaccgctggcaggcggccatctgggctttgacagagaaaaactcacatacctgggcgtagacacggagcatgcgggagataccttcaaaaaagcggagtatgatgacgagataaagggcatcatcgcccttgtcagggaatacgcgcagaagtacaagaaagagattcccgttgtaacggcaggaggaatctattcccatgaagatgtgatgcaccagctggaactcggggctgacggtgttcaggtggcaacccgtttcgtgacaacggaagaatgcgatgctccgatggagtataaacaggcgtatctggatgcaaaagaagaggatattattatagtgaaaagccctgtggggatgccgggacgcgcaatccgcaaccattttctgcgggaggtggagaaaggcagacaggcgatttcacattgttaccggtgcctggagaaatgtgatcaggctaaaataccttactgtatcacgcaggcccttgtcaacgcagtgaccggggacgagaacaatgctctgatcttctgcggcagcaatgcgtggaaggcggacaggattgagaccgtacaccaggtgatgcaggatttgtgccggggctgaccttccggaaccaaacggaggggaaagaagacagaaattagaagatagaaaatagaagataaacgagaacagataaaagaacgcagcggccatggtttcctgccggtctggcaacaggcaggatcccacggcggctgcgttcttttgtattcttatcctctgaatctgttaaggcaggcatatatctcctgaacccttggcatacataaccccattgccgtatagttcgagccgttaaaggcagccagtcccttcttctcatattcgagcatgagaatgtccacggtttctttcagcgtgcagcgtgaaaataatccgcgttcaaggcagaagcgtaccatttgggccagggccgctgtctgttcgctgtcggccagctgttcgacgaaacggagatcgacaggctctttgcccacctgaaatgaatccctgccgaatattttcaccttaatccggtcgtcctgttttctgttgccccgtctgtcgccggaatttgcacctccccgtccgctgtcggagcttgctgcaggggcgggcagctttcttcctggcttgggaagagaaaacccgggcgccgtcagggcaggcgaggaaatctcccgataagcctcacaggctttctttacctgttccgtaatgtcgagggggcggtaagaatccatctgaattaccgtatccgcgatatagaagtaagcgcctgagcttccggctaccagtaccgtggagataccggctttttcatagagatctctcgctctctctatgaacggagtgattggttctttatccctgctgacaattttctgcatcagctcatcccggagcataaaattggtggcggaggtgtcctcgtcaatcagaaaggcggcagcgcctgcctcaattccttctataacagccgcggcctgggaagtgctgccgctggcatctgccgatgagaaacgggaggtatccctgccgtttggcagatcgttgataaacagggagatgtcgacattactgatgctgcgtccgtcctctgcccgcagtttaacggccgtactgtccgtaatgacgtattcccggccgtcaccggcgatatgattgtacacaccggcctccagagcctttaaaagggtggatttgccgtgataaccgccaccgactatcagtgttatgcctctgcggactgccatgccgcaaagggggccgtggtgcggcagattcagtgttattttcagggactcgggggaagaaaagggtacgcttcctttcatcgggcggtccgatatgcctgtttcacggggcaggacggagccgtcggcggcaaaggaaacgagatccaggcgtttcagctcgtttctgataaactcctggtcttccgccagctcaatgacgtcacgcacctgtttcgggttcctgtttttatacataaagacatttctgacgcatccgggcagaaaatcaaacaggattttgatgagctctcccgaatttatcgttcttccaaaagccgggaagccgacttcaaagcgggcggtgattccggttccggtacattcacaggccgagcgggtgagaacctcctgtcccggtctgcttgtagcgatcagtccgcttttgccggagccttttgctttaaaattaaatcgtgcaatttcctggctgaaacaacgcagcagataatcctccagtgccgttttcttccattggcggtcataatatccttcgggaaatgcgttgatcttatgtgggataaatacgctgaccttggagggggaggcaaagggatccccctgaacatggtctaccgtcaagatgtagtctttaaaatcataggaaccctgaaccgctttataagcggggtagcctttatggtcgatggattccagcagtctttttaaatcctgagaatgattcatggtattttccttttctgttcttgattaatactgtgctgacaggtttgccggtgtgctggcagtcagcttttattgagtattttaattcattcgatgggaattggcaagtgtatggaagattatctgctgctgataatatggtttgttactattcacggcccatattccgcgaggtattttcgtgcgtattttgcacgaaaatcccgagttgcacggctcgacgcgatgaaaagtaaatttttcaccacaatcaacggcgttttttgccgtttctgtgcatcgcggaacgtgttactgttcgcggagctgcgctttttcagcagggccgtgaatagtaactatggttttatttttccgggagatggagagagaatgcgctaaggcagtaaacagggaaaattgcggggagggcggtaacatatccggccgttttgtctcatatattaagaacaagcgatattagtaggaagtagatttatgctgaattatctctgggcatttatgatgctggtcggaattctatgggcggctctgcacggcaacctggcgcaggtaacgaccggagcgctggattctgctagagaggcagttacgctttgtattaccatgctgggcgttatgtcattttggacggggattttagaggtgggcaggagagccggactgattgaacagctgtcgcggaaaatgacgccggttctacggttcctgtttccgggcataccgaaaggccatccggcgctggaatctatttcggccaatatgatcgccaatatgctggggctcggatgggcggcaactccggccgggctgcaggcgatggaagaactggaaggcctggaggaagaaagacggagggaaggaaaaaaattcgtgcctcagggggttgcaagcaatgaaatgtgtacatttttgattatcaacatatcatcgctgcagcttattccaatcaacatgattgcctacaggacccagtatggcagtatcaatcccactgcaattgttggtcctgctctggtggcgacaaccgtcagcacgatcgtggcggcaatatattgtaaatggaaaaacagaaagcggagctgacggctccgctttctgagtgattgatggcggtgacctgtgcagagcgtgcaggttatcattgaagacaacggcctgtgcgcagagcgagcaggttatcgttccggttcaaggcgctccgcccttgactttcggtgtgaaaaatatagtttatccaagcttatccgcccattccggctctttaaatccgaccagaacgaaatcctttgccacaatcaacggacgtttaaccagcattccgtcctccgccagcaggtcgtactgctcttcttcgctcaaagaaggcagtttttcttttaagttcatatttttatagagaaggccgctggtattaaagacttttttcagcggaagaccgcttttctgatgccacagttttaattctccggcagtcggattcttttcttttatatggcgggattcatatgatacattatggctgtccagccatttctttgccttctggcaggtggaacagggaggatattctaaaaacagcactttcataataaaaaatctcctttctcagattaaggtgcatggaaacatggagtctccgacggaaatcagcgccggatttctgcggtgagcgcagaaaccgtttatgcgcaggtataataaccgctctgcggtcattataccataagaatggttttttgacagatgaatgtaatttatgggacaggtttcacattatggtcacaagtctcatatataatcattctcgaataatatgattttatcagtatggaaggaggcctgggcgaataaaatagaagtaataacggcttcatcaggagcattgaatgaaatttattctgtacatatccgaatacctggttccaattattattttttacattgccggctttgcatttctttctaagcggccggtattcgatgactttattgaaggtgcaaagcaggggatgaaaacggttgcagaaattctcccgacgctgattggtctgatgacggcagtcggtgtgctgcgcgcctccggatttcttgattttctgtccggtttattggagaaaccggcttccctttttcacattccggcacagattgtacccgttattttagtgcgcctggtatccagctcggcggcaaccggtcttttgctggatatattcaaaacctccggcccggattcctatgtcgggatgatggtgtcaatactggaaagctgtacggaaactgtattttatactatgagtgtttactttatgacggcaaaggtaacgaagacaagatggacgtttgcaggagcgatgctggccaccggggcaggggttgcggcaagcataatcctggcgtctgtcggatgaaagaccggaaaagaatggaaaaatgccattttttgtaagaattttgacggttgttttgacagggagaatattgtataatcagttagtacgcggatcaatacgcgaaaactatgaaatgaaagggaatgccgtggatcattacgagactctcaatgaagtgctggtaaagctgttccgtgatattatggatatcgagcaaaaagctataataacacaggaatttaaggatatcaccaataatgatatgcatgtaatagaagcgattgggatcgaagctccgaaaaatatgtcctctatcgccagagagctgtcagtgacggtgggtacccttacaattgcaatgaacagtcttgtaaagaaaggctatgtggagagaacacgcggcctggaagacaggagggtcgtgtatatatccctttcagaaaaaggcagaaaagcttacgggcatcatgcccagttccacaaggaaatgataaacagcgtaaccagcgagcttaccaaagatgagctggagactttgataacagcattgtccaagctgagaaactggtttgaccactggaaagagtagaatacgaggaggcatcacgcaattatgaagagatttatggtagtattaaccggtgtcattatggcggcagcactggccgcatgtacgccgactaaacagagcagcgaaaagagaaataatccgccggccggagccacacaggagtcctctgttgacggagcgcttgagaaacaggagatggtagtggatgcagaaccatcggtcacggtctgcatttactctgtaaatgataataagacaggtctgaagcagaatatggatgccgttgacggcgaggaactggatgcgcagctgttgatagacaagatggcagaactgggagtgattgaagaaggcgttaaggtcaagagctttgacaataaagacggtgttctgacactggacttatccgctctttccggttccaaggatgaattggtcattacatcgattgttaacacatttatccagaactatgaagcggaagagatgtccctgagcgtaaatggagagaagctgggaagcggtaattataagttcgtcaaggaatataaaaagatgaaataaaatttacagagataaaatagagaaaaaagggtttcactgaatgttacttcggtgaaaccctttttttaattcgtcacgtcataagtcaggagccaggtctcgaaatagggtttaataacccggaaggaagctccctccatatctaaaataaatttgtggaacgctttgggcgaataacggttaccaagcgttttcttcgctgaatccctcagggtgcagatctccagataaccggtataatatttcaggtaatttccaggattgtcaatgatggaatgaaacatttcctcgcaaacctcagcatcggaaataccataatacgtttgcaggaaaccggataccttctccaaatcccagccgtcatagtgaatatggatatccagcagcgcatacagcgcataaatagatgcctggctgcgtgccatcagttctttcatatcaggagatagtccattgtcgaaagagtaactgtacagttcacagtaaagtccccatccctcatcatatccgccgcaggagaggatatggcgcaggggacagctctgcttcctgttaaagtagacggactggtataggtggcccggataaccttcgtgggccagaaccgaatacaaatcagtaccttcttccctggatttgtcattgatgtaaattacattagtggtatccgaatcgatcggcgggatcaggaaaaatgcaggtgacagcgaagattcaagtgctttgggcacatgtttaacctcataggtggagtctgtcagttccggaaaatccgttttaatctgttcacgcagatggtccagaatctccaccggttcactcagagagaagctcgtgcgttcaatctcctgaaccagcgccggattattttgaagtaatttcgctgtttccgccatatcgcttccaaatttcttttcaatcctgtttttaagctccggaatggaactgtcggtaccggtcagggtagcgaccagatattcgtaataagctttgcctttctcatagtggcaaagaccattttcatttgtccctctgccttttaactcttccaatgctttggacaaggttgtgtaggccggaataaagtgttcttttaaaatctggagatgctttgtcttataagctgttttctcatcctctgtcaggccctccacttcatccagacggctgttaaaggtttccgtcaggaagctgttttccggccggatcagataatccttgcaggattggagcatacggtcaatggttatatcgcttggggccaatccggcgtcggccatttccttctcataggcggccagttgtccatagtaggcgtcgatctgtgaaagaagctccaggtaatgttctatatcggtcttgtcgtaaaaggtatattcggccagtagtaccggaagctgggcctgagttccgatcagcgggctcaggggctggctgtaaagctcaaggccctttgaagagagggcaatctccagtgagtcctccagcatcttgtaggtgaaaagctgatcggacgtgagcagcgacggatcgaaggcttcaagctctttcagcagttcctcattatctttagtatcctgctccagttctgatttagatatagtctggaattttatctccggtgtttcaataccgtagttttcagggtgtctgaccataaagtggagattgagaggatcagaaccgataatttcccggaaaacacgatcggtaaaagtattaaattcagcctggacagtggctgcatctttgccgctgttcttgtctgtctgcccgccttctccgttaccgccctcttcctgcccgggcagttgcaccggctgcgtttcggatgactgaaaggattccaccggcggattataacgggaacagccgctgagcataattgcggtcacaaggaccagcagatagtataaacaggttttacgtgccttcattttttacctccaattgcctactattataatttatattaacggagattacaacttatcaattaaattgagatttagttaagcaggtgaggacgccgccgcaggccagcggacggggtggtgggattgttttatgggtctttcgtcccggaagtttggcatcgctggatggagaaggagatactgtggttttgttttcgcagggcggagccggagagaatgatatccggctggactgcttcttcgagggatagctctaagacagaggaaggcaaagcccccggggctacggacaaattcgctccgaactccgaatgagttcgaagctcaagttgtcccggattttgcccttgtagggctaaaatccgcccggcgcgctttgtctccctctgcctaagagctatcatctctcgggcgaacgtccttccggatatcattctctccttctccgccggaagatgtcggcagtatctccttctcccggaaggttttcgccgggacgaaagactccgccaagtgtatcggccccgtccactggcctgcggccgctgaatgtctcacgcgttaagtgcgggggcggaccttgtcgcggccactcagcgcttccgtgtgcgggaaatacgatatgccttcaatgcacctttattaaggaattatggaagatttgatatcggcctgccggaaacacgtagtggccgcgacagggccctccccatttaaggttggagacaatcagcgcccggaacggaccatgtccggtgtcgaaaacctccgcctgagtgttccgtccccggtgaaaaactgacctggggaagtaggcggaatcaattgcggaggggacatgggagtccgccggtgcttagcgaggtccctcacgagcttagcattccgatgcgcactccaaagagtgcaaacggtccccgcagcaattcattccggccggattccccctccacagcttacctcccacggggacggaagactcagccagccccctcaccacaccggacatggtccgttccggacgcgtcctcccaacctcagttaaatctctatttgccacaccccccaatatatgataaaataaaaaaacttatagaaaaaaaggagtacacaaatgaaaagagagcatttgttttccctggattttgtacgggtgcttgcggccgtgatgatcgttattttccattacaatgcggttactcttatgatcccggaagtcaataaaccgatacttttatttgtccactatgccaacggaagtatgggacatatcggtgtttccctgttctttattctggcgggagcgtccctgatgtattcttcgatggagaaactcgatttaaaacagtattttaaaaaacgttttctcgctatattcccaatttactggacggtttattcggctttttttgtatataattatctgattaaaagagtattcaccttcgataagccgttatggaggctgctgctcagcgtaattggtatggatgggtatctgaattacctgattcccaactattatcttttgggagaatggtttatcggctgtattctcctgatttacctgatgtttcctttccttcgcaaatgtatgctcagatggccggtgcttacccctgtggcagtcggtatgatctatgttccgctcacgctgttttatccgtttcagatggatatccagttctttttccttctcagggtgccggaagtgctgttcgggatgtattttataaaatatttgtatggaacgaaacagcagagggaaaaatataactggaaatggggattgtgttcgtttgcggccgtttgtacggtaatgacgattaagacgtcaattccggtgccgtttaaaatcctctggaccgggatacctattttccttttccttgtctgggccggccagctaatccggaatgcggttgtaaggaaggggatttcaatttttgcatcatatacgttcgccatatatctggttcaccatatcctggtgggaaaatttgtgtttcctcttgcgggcaggccggtggggcgtctggagaattacctggtttttggaaaatattttttgtttatcagcgtggtcggcctggtattttactggttgagccggattttaacgcaggttgtgacccttttcatccgggttttaaggaatccttcttgacaaaaaggagcgaaaccgctagactaaacctatgttggaaaatcaagcatagaactgtataatacaaaggctgtgaagagaagagtacgcagaaagaatgattacagagagtccggatgggtggaaacggatgtcaggagaactgccgaagatggtctcggagctgcactgccgaagtatgaacgggattgaagcatggcctgcaggccgcctgttcattttaagcagtgacggaaataaggtccgttaacaccgcaggctgtgaatacgcagtgcatcgccaggagcagagccgggatgcagattgctggagacagccgctgaggcatccgctgtgaggcggcatgcaaattaaagtggtaacacgggaaaataagtctcgtctttaacggtgaattaatcacctttaaagacgattttttatttaacaggagaactttcctgttaaataaaaaccgctccgcggaggagcgcactgcggcggcagagaaatatgtaaaattataatcattacaggaggaacaaatctatgtgccggaattgcaaaaaaacatattatataacaacggcaatcgcctatacgtcgggcaagccgcatatcggcaatacctatgaaattgtcctggcagacagtattgccagatataaaagggagcagggctttgacgtccgtttccagactggtacggacgaacacggtcagaaaatagaactgaaggctgaggaagccggagttacgccgcaggaatttgttgacggtgtggctgcccagattaagtcaatctgggatttgatgaatacgtcttatgacaaatttatccgtactacagacaaagagcatgaggaacaggtacagaaaatctttaaaaagctctatgacaaaggtgatatttataaaggacattatgagggactttactgtacgccgtgtgaatccttctggacgtcgtcccaggtaacggacggcaaatgtccggactgcggacgcccggtcgttccggccaaggaagaggcatatttctttaaaatgagtaaatacgcccagcagttaattgatcatatcaatgagcatccggagtttatacagccggtatcccgtaaaaatgagatgatgaacaacttcctgcttccgggacttcaggatctctgtgtatcccgtacttcatttaagtggggaattcctgtatcctttgacccgaagcatgttacctatgtatggctggatgcgcttacgaactatatcacaggtttgggatacgattgtgacggtaaccacggagaattatttggaaaatactggccggcggatttacatctgatcggcaaggatatcatccgtttccacacaatttactggccgatcttcctgatggctctggagcttccgcttcccaagcaggtattcggccatccatggcttttacagggcgacggcaagatgagcaaatccaaaggcaatgtgctttatgccgatacgctggtagactttttcggagtggatgccgttcgctattttgttctccatgagatgccgtttgagaacgacggagttatctcctgggaactcatggtagagcgtatgaattccgatctggcaaacatccttggaaatctggtgaacagaacgatatccatgagcaataaatactttggaggcgaagtggcggataaaggagccgcgggtgaggcagatgcagacctgaaggcgactgttctggaagcggtgaagcgggtggatgagaagatggataagctgcgtgtggcggatgccatcacggaaatcttcggaatcttcagaagaagcaataaatatatcgatgagaccatgccctggacactggctaaggatgaggctcagaaagaccgccttgccacggtgctttataatctgacggaggcgattacaatcggagcttccctgctatattcgtttatgccggagacggcagagaagattctggcgcagttaaatacgcagaagagaacgctggaggagatggggacattcggtctttacccttcaggcggtaaagtgacggataaacctgaaattctttttgcacgtatggacgtaaaagaggttttggaaaaggtagaggccatgagagctgccgaagaggtaccggcagaggaagaggcaaaagaggatgagaatgtgattgatctggaagcaaaacctgagatcacatatgatgattttgcaaagctccagttccagataggtgaaattattgcctgcgaagccgttccgaaatcgaagaaactgttatgctcccaggtcagggtgggcagccgggtaagacagatattaagcggtatcaaggcaaactacacaccggaagagatggtcgggaagaaggtcatggttgtgactaatttaaaaccggctaagctggcgggaatgctgtcggagggaatgctgctctgtgcagaagacagcgagggtaatcttgcactgatgaggccggagaaggatatgccgtccggagccgaaatctgttaagaaaccggatatggatttttgcaggaattgcaatcggctggtgatttgccccgcccggagatatggtttccggacggggccttgctctatccggaaactggccggacaggagaggagacggttaaatggcggagaaaaagacagcccttgaaaaggaatgggaatcgtttctgagacgcgagaagaaactgctcagaaaatatggcagaagaaaagagcctctattggaaagaaaattgcagaaagcagttccggacggcttgagcgaaaaactggaagccgcgttttaccgggcattctgcatgattttggaaaatggaacggcggcaattgagaagacttttcccaaagacaggctggaagcggaatataagacgagggaatatgccggaacggtttatccggtgagaaagaacctggcggcgggccggaaactggcggccaggaatgcggctgccggggtggctggagcctgtgcagagggggcggtgctgggccttctggggattggccttcccgatattcctatttttctggccgcgctgcttagaagcctgtatacccaggccctccattttggcgtggattatggaaaggcggaagagcaggtgtttttgctggagcttctggccctgtctctctataacggagacgattttatggagcgggacgccgaaatgaaccgaaaaatttaccgcatggcctgtgaagatgacagtcagacaaagcgtgaaacgaatctcaaacaggctgcgctcaaagcatccggcgccctgtccggggaattgctgtacatgaagtttttgcaggggatcccggttgccgggttaatcggcggcctgtatgacggcatttatatgaaaaaggtaacggattatgcggcggtcaaattagaaagaaggtatctgttgacaaaatcagaggcagatcacagatagaaacagttactattcacggcccatattccgcgaggtgttttcgtgcgtattttgcacggaaatcccgagttttacggcgcgaaacggcgttttttgccgtttctgtgcatcgcggggcgtgttactgttcgcggagctgcgccttttcagtagggccgtgaatagtaactagaaacagcccgaaacggaagaaaaccccgataatcgttgttttttaacggaagattggctataatggtgcatgaatacaaaaacggagaagaaagccggaggaaacaaatgatttttgatacacatgcccactatgacgatgaggcatttgacgaagacagagaagcattgcttgagggcctcacagagcatgggatcgaggccgtagtaaatataggaaacgatatgctcagcacagagcatacactggagcttaccaagcgttatccgcaggtgtacggcgctgccggggtgcatcccagcagcagtgcggagcttgacgaggagaaattcagccttctgcggacagcggccatggatccccagattgtggcggtgggtgagaccggtcttgactattactgggacgagccggaccgcgggatacagaagtactggtttggccgccagctggagcttgccagagaggtgagaaggccagttgtcatccacagcagggatgcagccaaagatacatttgatattatgaaggaacaccgcgcggaagagattggaggggttatccactgtttctcttatggcagggatatggccagagaattcctgaacctgggattctacctcggaatcggcggggtccttacgtttggcaatgcaaaaaagctgaaagaggtggtggaatacgctccgcttgaccgtctggtcctggagaccgattgtccctatctggcgcctgttcccaacaggggaaagaggaattcgtcttataatcttccttacgtagcggatgcgatggcggaaattaagggcctcagccgggatgagattatcagagcgacgaacaggaatgccaagcagctctatcgtctggctccgggaaaagcagaaaggaactgatatgcgcatagatttgggaaatccaaagaacacgatagagataatacagaagtacaatttcgctttccagaaaaagttcggacagaactttctcatcgatacacacgttctttccaaaatcatcacggctgccggggtcacgaaggacgacatggtgcttgagatagggccggggataggaacgatgacacagtatctggcagagaatgcgggcagagtggtggctgttgaaatcgacagcaatctgatcccgattctggaagagacgctgaaagactatgataacataaccatcataaacgaagatattctcaagcttgacataaataagctggcgcaggaatataacggaggaaggccgatcaaggtggtggccaatcttccctattatattaccaccccgattattatgggactttttgagagcggggtccccatcgataatattaccgttatggtgcagaaggaagtggccgaccggatgcaggtgggaccgggaacaaaggactacggtgctctctctctggcagtccagtactacgccgagccgtatatagtggcgaatgtgccccccaactgttttatcccgcgtccgaatgtaggctccgcggttatacgcctgacgcgccacaggacgcctccggtggaggtggacgacagggagctgatgtttaagctgatacgggcatctttcaaccagaggcgcaagacgctgctcaacggtctgaacaactcaccggaaatcaatatttcgaaggagaagatagcggaagcgattgaggcgctgggagtttcggcatccgtccggggagaagccctgacgctcaaacaattcgcagagcttgccaatctgctttctgtcgagaaaacggaaatataaaatggaaccgggatccggagagcgcctttttagaaagagggcggttttcggatcccggcaaaaagaggtccggcaaattaatctggaaataagataaaaaatccttgacaacataaagaaaatcgagtaaaattatttacgttgctggtaacaccagtacggtgagagtcagttgatttctcaggaggcccagatagctcagttggtagagcagaggactgaaaatcctcgtgtcactggttcgattccggttctgggcatttgaaacataatttaacagattacattatgcgggtgtagttcaatggtagaacactagccttccaagctagatacgtgggttcgattcccatcacccgcttttttgttgcttaaaacccggaaaaccaagcgtaaagaggttttccgggtttttgcgtatcttgcgcctaatcggcggtctgattattccatatcgagtggcatactctgataaacttcttgaaatgagggggaagaaacgtatctttatgataaacaatataaaaataccgctttaattccatatcagatatcgtacaataccttaaatttttcagcttcacatcattaataaataattttttagccatgattgaatatgctttgctgttgtttacttcaaacttaatcgagtctatattccgatatacttctttcaactggaatttatatcccctggccgctaaggcatgttcgaaatattcccgggtagaattgcctttctcccgcatgattaatggatgttccgacagatcctttagagaaattgaggacctgttgcagaattcactgtgttcattgtaaataaacacaaaatcatcttcagcaattttactgcatactaaatactcgtgatcaaaaatttcttccgtcagtacgaaatcgatttctccgttcaacagtttattcttaagaatataattatcgtctacaatcatctttgtttttacatcgggacaatgataatgataatcagaccagatctcattcaggatgctggaaatggtgataagagtggtgccgatacggatcactttgccaagtgaatttttaatggcttcttccatttccgtatacaggcctatgatttttttactgtaatcgatgaatatttttccctgttccgtaatgacgagttttttggacaggcgttcaaaaagctttacattataagctttttcaatatccagtatcgtttggctgacagtggactgcgaaatgtacagagttctgcttgcggcgctcatattgttgtattttgcaacctctagcaatattgtcatttctctgattgtcatttaagcctcccaactatcgattttgcctatgatgttatcatattttactgttttaccgaaaatatgtcaagtgttataatcgaaaatataaaacggccggattatagatattaataaaaataaagcattctggtgatatgtcaagaactttttgaagaagattttgatatgtttttcagaaaaaagggtaactttaacagaccttcggtatattttacgtataaccgaatgtcagttcgactcaatattatattcggtgtccagcttttcgccggtgtacagttggtttttgaccagcaatccaaaaacgagtcgtactaatttacgagatgtaagcgcgagtgctcttttgtgctgatgtttggttacctcagcatattttctggcatagaaatcagcatattcagggatgtgcttcctgacgctgtttgccgcttcgccaagatagcagcgaagatagggatttccggctttcgacattttgttgtcctcagaagtgaaatctccggaatcacccttaggccagtaaaggccggcatatttggcaagggcatcggatgaatggaacacggttatatcgcctatttctgatagaattccggatgcccatatcggacctattccaggtatggattgaaggatgagcagggcgttagggttcattccgttgatgcatttctcaatcgcctgctcgatcagcttgatttctttctgataggcgtggatgcagttaaacgagcttgccagtgatatgctcagtggttcatacatgcacttgtctaaccggtaggaatccctggctgccttgcgcaggagttccgaagtttttgataggtcagagatgcggttcctgctcttccccgcaaggaaggtaagcagctcctcttccggcatatcgataatctcctgcggagacaaaaattccgtcaggacagctgaggacgtggcaccatagagactgccaaaaggcttgtcatcaccttcaaggagctgaagttcactgaacttcagataaagattcgaaaccatataagtcttctccctggtgatgcactcagaaaggtgcatacggtgccttgtaaggcgtttcagggatatgaactgcccgccgcgccatggctccagttttttcgtgcggcctaccctgccgaagtccgcgatgagatatgcatccgtgggatcggtcttttccattccgatataggattttcggtaattcgaagcggcctttgggtttacacagaatacgtaaggcctgtagggcatgagaacctcgctggccgacaggaagtttgaaatatgcacgctgtatacagaagtagattccagcacgataagaaccgtatccaggtttttatgcttctgcatgcattcggcaatcatatttacaagctgatcggcgcctggctggttattgccaaacgacgatgagatgtatttgttttcctcaaagtccatggcatagacggcattggtctttgagcttacatcaatacctacaaacaaggtggacatatagttgagctttaacatgatatcacctccattccgatggggatttgtgaagcctgaagcaaaaggtttatcctgtgccgcatacggtgaccgaaccctcgcgcaatgagcatgcacccagtcagccttttttgctggggctaacggctggggatgaaaattctgtgtcagcggaatgtgccgtatgtgccaggctgaatgctttcaaagcagtctcggacgaagccggctgaaaggaggagaagcagtgccttcggacatcagactctacctgatatcataccacaggatctacctatattgaaatgtaactatcaactgtatagatgggaatcgggatgaggggagtacctcttagatatccttaccatttatacccaaaaaagaataagtctgtaagcggtttttcttgcttacaaacttattatacgaggaggaagagtatgcaaaatgcgcttacaatatctgggaataatttgacattggatgatatttaccaggtaagccataagcacaggcctgttgaaatcgaagagaaatcaatggaaatgctggttaacaccaggaaactggtctttgaactgtccggcaggggagtgccgatctatggctgtaatcgtggagtcggctggaataaggacaaaaatgtaaccagtgaaatgattatccggtttaacagtaatatgatgcattcccacgccgtgggagtgggaccttatgctccgcaggaggatgtgagggcagccatgctgatccgcctgaatactgttttattggggtgtacgggtctgagcccggagattgccgtgcttttaaaggagatgctgaaccgtgaaatccatccgttaattccggagcgcggttcggtgggagaagcagttatcgtaaatctttcattcctgggtctggccctgatgggagaaggtcttgtgaattacaggggaaaggagataaaagcaaaggatgcttttaaagcggagggaattgaacctgtaacattaagggagaaggatggtcttgcagtcatcagctccaacgcattttcagccggacaggcagccagcgtactatttgaaaccgaactgctgcttaagacggcagacattattgcctgcatgtcgctggagggattgagcgggaatgtttcatccctgcgggagggggtacataataaacgccggtatgaccgtcagacggaaactgctgcagacatgaggaagtatctaaaaggcagttatttgtatgaaccgtgttccggccgtccgctccaggatccgctgtcctacagatgcgttccgcaggttcacggagctgtcagaacggctatggattacgccgcctccaatttgaccatccagtgtaactcttcggatgacaacccatgcctgctttatgaagaaggcgatattgcctccaatggaaactttgatcctctctgctgggttttgggcatgcagaatctgggaatcgcgctctgccacatatccaggctgtcctgccttagaacaattaagctggcaagtcccggttttacgggattatcccggcatctgacaccggatgaaggcacaatcgccttttccaccattcaaaaaagctttgccaatctggatgcagagatacgcatgcttgcaaatccagtaacaatgaacacgtattccctctccggtgacatggaggatatcagtaccaatgcgcctcttgttatgcagaaagataaaaaaattatagacaatttgttttacattctggcaatagaacttttgcatgcaggacaggctatgagcctgagaaatgcagggaactgcggaaaaggaaccggggccggatataaggcactcaggcgtgtagttgatttttacgattcggataacagaattctttcaattgatatcgataaggcgtatgcgcttttaaaatcgggtgactttttaaaatcggtgttaaatggtttggaagactaaaacagtaaggggaaaggggaatgaaacaatgacagatggaaaagtcaaaacgggagccaaacacattttgctgagaaaaggggttaaggattttagagaacaatcaggaagaaagaggagcatatggaaattttatatttgaattctaaggatattgaagaaattaatcttaccaacgatgaaattataaatgcggtggaagacagcttaaaagcacagggggaaggaaaaacctccattgagccgcgggttcatatccatccgaatccggaataccacggacattttaatgtgctgcgaggctatattgagcctaagcatgcggtgggagtcaagattgtgggtgactatgtctttaactatgaaaaaaatcttccttctgaaatgtcactgctgaacttgtttgacccggaaacgggagcgccttatgccgtaatcgacgcaactgcgattaccaccatgaggacaggggcaataaccgcggttggggctaaaaaccttgccaaaaagaagaataagatcctgggccatttaggctgccgcggaacggcgttctggaatgttgtcctgcttgaccatctctatgattttgaagagataagaataaacagcagaagacgtgaatcaatggaatctttcgcaaagagcctggaggcacggttacacaaaaagataacgattacggaaaacagccgggaatgcctggagggcgctgatattatggtggaggccacccgcctgatggaacctatgcctctgctgaagacggaatggatccggccgggaaattttgtagttccttacggaactatttgcgccaatgagataaccctgacggatgtcatggataaaattgttgttgatgactgggggcagtgcagggaaggcggcaggctgggaagcctcagtccgcatgtgagagctggcaagctgaccggtgaaacgctgtacgcggagctgggagatattgtggcgggaagaaaagcaggaagggaaagtgatgaagaaaaaatcctgttttggcacagaggtctttccatcaacgatatcgcgctgggacagctttactatgagaaagcgctcgcttcgaatatcggaacaaagctgttttacagataaaaactaaaagacccgtccggaacgtaacagtcccggacgggtctttagtgatggcggcggcctgtgcgcagagcgtgcaggttaacgttgcctgaaaaatcctattttgcaaaatcttccttcctgaacagggagcggagcaaaactatccagccccaggagagggaaaaggacggcatgcaggccagcaggaccgcctttacaggaggaatggccgaaaagcagatgggaccgaaaaaaataacgaaagtggctaccagcatgaccagcagcgtgattttttcttttctggtatttgggggagtaagaaaaatttttgttaaatccatttccacctgtcttttttccatgcttttcatctgcacatttctccttttttaattgatagatagttatatatagcgatttgatagtatgaatcagtttaacgtacccgttatggattcgacaatccggatcaggtgtccggaatgaatcagttccctgaggtattcgatgtaaggatggaggaacatatcctgttccatgatggggacatgtctgccgatttccttcataacagcttcagtggctgcactccttttaacgtcggtatccaggaactgctgcgtctcataggcggaaagcagctcgatggccaggatatactccagcttttcggctgcagagcccgcttttttgcaggcgttgtatcccatagccacatagtcctcctggtttccgcaggtaggcgtgttgtcgatggttgcgggggtagccagaatccgcatctcattcagcaggccggcctgcgtatactgagggatcatcaggcccgaattaaggcccggcgtcttgatgcagaaccacggatttccggacaggctttcgtcaatcagacggttatttctgcgctccgacatcttggcaagggcagcggcggcaatgcaggcgctgtccatttcgattcccacataggaggagtccgcattgcaggctgagatgacatcctcattgccctgtccgggccagatgattggattgtcacagcaggaattcatctcaatctcaatgacttcctttgcatccttcagtgtttttttagaagcgccgtgaagctgcggaatgcagcgcagggacagggcgtcctgtacgcggctgcctttatatttttcgataataccggagccgtttaaaatcgttctcacattttctgctgttttagcctgttcactgtgggggcggacagacataacacgttcgtcgaaggcgttcatcacgcctttgcatgcctccagtgtggcggagccgatgatgtcggctgctttggccgcgtttagaaggtcgtaaatcgccagggcagccatagcggtgggggaggtggttcccgatacaagggcaagcccctccttggagcttagctctaacggtctcattcccgctctcttaagcgcctcgccgccctccagcagttcaccttcataccaggccttacccctgccaagcagcacaagggccatatgggcttccggcgccagatatccgacgcttccgtctcccggtgtccagggggtgatgcctttattcaaaaagtctttataatattctaaaatggtcaggcggactccggaataaccctggcccagattttggagcaccataagcatgattcccctgacccgctcaatagacaacggttccccgacggatacggagtgtgagaggatgatgttctcctggagtttggccgtttcatctttaccgattgctttggtgcagagagcgccgaaaccggtggtgactccatacatgactttctcttcggaaacccattgttctaccagttcccgggatttttccactcgtctgcaatattcatccgagaattcaacggctgcgccatatctggcaactgcaatgaaatcgtccagtgtgataggagcgcctaacacgatattttttatattgttggctgtatttatactattttccatattgatttgattttaccttcatagagagttactctgtctgcgtgttactctgcccggatattacttcaggcttccccggttttggcagttccggcctgaatgtttttatccgtatattcggcgcattcttcaatgtcctttttcgtctgcgggtcaaagaagaacactttgatggaagcgattacctgaaggataaagatagccagtacgacgaaaccgccgcaggccgccaggtatttaactccgtccacaccctgggaaccgccgccgaatgcaaccatgatgcaggcgatgagtccgatggagacaccccagactactttctgccagagagccggctcttcatcgtggcgggcgccttccgtacagagggccgcaatcgtggttgacatggtatcggccgttgttgagaacgccgctatcaaggtgatgatgataacaggaatcaggattgctcccaacggtacatgctttaagaactcccagatgccggatacggctccgccttcattgatggcagcgatgatatcggctttgccgctgatctgccagtcaagagctgtgctgccccatacggagaaccatacgaaaccgaaagatgccgggagaatccagttgataatcaggaactgccggattgttctgccataggcaatgattgcaaagaagatacccattaaaggagcataagcgatccagattgcccagtcatacatcgtccaccaggtaacaagcgcttctccgcctactgtgtaagggtcgaatccccacatccagaagcggtcgagccagtagccgagtcctacatttgccatgttgaggatgtaaacggtcggcccgatgatgaagagaaggattaaaagcacatagaaaatttttgatgtcatgcctgccagccacttgatgcctttatcaataccggctacggatgctgccgtgaaagttactgtgatgattgccgtaaggatgaaccatacgacaggaccctgcgcgatgccgtaggctgcggaaagtcccgtaccaatcagtgcaagtcctgcgccgagggaggctgccagaccgagtgcaattgccagtacggataatacgtcaaccagcgctttccagaagcccttcgtcaccttctcgccaaacagcggtgtcagtgaagcggaaacggataattcctgtttgcggttgaaatacatgtaggcgatgataacgccggaaagtgcatacatggcataaggaataacggtccagttatagaagctgcggcccattgcgaaataggctgcctcattggaataggcctgaactccgtagccgtccagttccccgtatacattgccgaaataaatcagaacctcattaacgccgtacgtaatcagtccggttgcaatacctcccgtcagggtcatggcaaaccaggaaccgaaagaatactttgcttttgcctcaggtccgcccagcttaatcgtaccgatttttgaaaagcacagaagacttaccagaatcagagttacaactgcaattacctgatagagccagccgaagttacccagagaccatgtgaaaattgccttggtgacttcagtgagccatgcattgttcacgataccgagaatggcggccccgcctacgattaaaaagcagggaataaatacgctccaccggatcggcttagaatttgaatttttttcactcatgttttttgttgtatagagttacccccatggaactccatactctcctttccgtttttctgatattatataaagcaaaaaccgtgccaacttttttgtttttgccggagtggtaaaaaatatattatagtaatacacaattttcgttgtatttaacagtattttgaaagaaattaaaaaataaacaaatttgcggctgtctgctttggaaaaaaacagagtgacatatggaagcgttttctgtaaagaatgagtcgatttgcgccaaattattttgcttaatgccaaatgatttggcatctaaacttgacggaagaatcttttttatggtactatgtttcgtaaaagatacgtgctgaggtgagggaacgggatgaaaatttatgatttttactttgtactggacaaaaatcaggtgatgctgagaacggaatgggggaatccccggtcggaggatatgtaccggctgctgttttcaaactggatactgaggggtgaaaaaccttcgggtgtatttccgatggcggacgaggaccaggatggggagctgttctgggatgaagatcattttacttttgaaaagataaaggtgtcaaaggagagatattacctctttttcaaaaaaaggaatgatcaggagtatctgtttgccaagacgctggatcatatttcagacgggatccagatttatgataagaacgcctgtgccgtattctttaataaagccagccgggaaattgcccatataccttcggatgtctccattgagggaagatatctgctggacatgtataatctggatgaaaatataagcacgattatgacatgcctccggacccagtctccggtaatcaacagggtggatcattataagtccagtgacgggatatcgattgccacggcgaacacggcctatccgatccggaaaggaaaggagattttaggctccgttgtatttgagcagaccagcgatatcgtgaagagatataataaaaagatgcaggagattgaacaggcgctgaagctctatgaggagcattcccattatacacggtttacaggatacacctttgaacatataatcggccacggagtaaaattaaaagaggcggtcggcatagccagaaaggtggcgtcccagaacagctcgattcttctggtgggggagaccggaacaggcaaggaaattttcgcgcagagtattcaccgggccagcggccgtaaggataaaaggttcgtcgccctcaattgtgcggccattcccgattccctgattgagagccttctcttcggcacgcaaaagggaagtttcactggcagcgagaataagccgggttactttgaggaggccgaaggcggaacgctctttctggatgagctgaattccatgagcctgagtatgcagtccaagatactcagagcgatccaggaaaatacattccgcagagtgggaggacagaaggacataagaatggatgtacgtattatttcctcctgcaatgaagatcccttccgtgcaattgctgataatcagttccgcaaggatctgttttaccggttatcgacggtgatgatagaactgccgcctctcagggaacataaggaggacttggaggagctgatccgttacaggctggacgccacggcctttcaatacgttcactcgttttccggaatttctcccgaggttatggaaatcttccggtcatattcatggccgggcaatgtcagggaactgttccatgtgctggattacgcccagaatgtggcggacggagagacgctccggcgggagcaccttccaggctatctgagaaaattcggtgaggagagccggggtgtgcagactttccagccggcaggggaagacaaagcttcggggtttatgccgggagtggagcttcagagtatcatggatgcttatgaacacaaggttttgcagaaggcgctggagcattatggatataatatcacgaagacggcggacgcgctggggttgaggcggcagagcctgcagtaccggattaagaagtatggaattataatataaggggcgccggaccggaataaaaaataaaaaaatgctgacttgaaaaagtaaattccagtgcaaaggtgaattccatcaccatttaaaaatcagtataaatagtagatatttttaagcatatttctaatgtttctgctataattaggctaacttcttacgaaaaatcatattttaggacagagaaaacaggccactggagttttgtgtgcaagactaaattccaccagccacattcaaaaaatgtgaaaagtttacttccagtccgacagcagatttttgtaagttagttaacggttatagcggatcagcttaggtgtcagattgacctcgtcgggggcaatgcgcctaagctgaagtgcttttaaagtatcttcgccaaaggattccaaagccaattcgtatggtgttttgccattcagactttcacggggcgtggaattgatatggtccacaatccgattcacatcccactgtgtcaggaattcaaaactggttcctttaggaagcaccatacgcagcatagtgtgaacattttcaacaccacctttctggccactgcgcatgggatcgcagtagtataggctgcagcgttggaacccgttgattccggtctctaatgcgtccgggtccccaaattcagagccacggtcagttaacgtatattcaaatagggaaagaaacttataagtgccaagacgcttctccaggtggtcaaagacaagccgtacagcgccttttgtacagcggttcatcagaaaggcaagaaatagtttctctttggtaaaatagaacgttaacaacgtttttctggactctcgtgaggagtggactgtatccatttctgtaaatgaattaagtcctaacccttgaaaatcgagataggttctgcctgtaaatacagaacgatccgtaatctgggtcttgtggcatctacgtggtttgaacttgggttttcgctttaaatcaatgtttctggaagagaatagtcccttatcgatgtaggtgtaaatggtgcgtacagacatgcccagctccggatggtttacggcaatctgatagggagactgtccctgttcaatcaatggggagatgatcctatctttttgatgtaattcgtgctttgtaatgcttatgccgcttctggagtccttgagaatctggtggtacttacgatcagcaaagtgcgcattgtaggtatacttgtgagcaatcgtgcagtgagaaatcttcttgtcacaaccattgcagacatagggagccttgtccagccgggagcaatgttccttttgaaaatcggggcaggtctggttgcaggtagggcaggaagtacatttgatgccacaaacaaggatcttattgcagacgttcactttgcgacagttgtatcttcgtacacaaaagttctttgcattatagaaggagcccttgtgataccagtcggaggctctacgcaatttcacttctttggaaatggtagttggatccttgcagagatatttagcgatgtccttgaaagaacgccgctgatttaaagagttctcaataaaaacacgatcctcaagtgtgagatgcttctggttaccaggaataaatttattcataaaaatcatctccttctactgctgtcagaaggagatataaagatatcatgtatgtatgaaagagtaaatatcaactgtgcagaagtaaactccaccagacaaatggggagtggaatttactttttcatttcagtaaaataaaaaaattgcaaaaaagtgcttgccattgagcgtgaattatgatagaatacttctcgttgacaggtttgttaattgaacctgagagacatataatattatgcgcgagtggctcagtggtggagtatcgccttgccaaggcgagggtcgcgggttcgaatcccgtctcgcgctctcaaaagtaccgtaactacggtactttttttaatgcgtgttgtatttcgtgttgcatgaaccttaaaaattccttttttgactcgcgacaatctgttttatcgtatagggtaagccacgcctggtacttgctcatatccaaattaatgtcatccggttctacgattttttcaaagtacgtatcaatgatattatccaccttttcgcgttcctccgaaaaagtctgcatgtagatttttttcattaccttgtcagatttccagccgccgcgctcttgggcatacttatcgggtatccgcagcaaagccatgacagacgcgctgagatggcgaagatcgtgaaaagtaatatgcgccatgccattgtcatcctgtagcttaatccatcggtgatacagggcccggccactgatagggaccaggatgtctccgtccacctggtcgataagctgcttgatgtaaggcggtatccgatgacgccggttcctggcaggattctttcccatatcctttcttttcgcttctcggccaacatcgacaactacctcacggatagttatataattcccgctgatggattttgatttcgtcagtccgcggacctccgacatggaaaaagagagccacgccgctaggagtaccggcagctctatgtccgttcccttgatgatgcgcagcacgtcggcggcggaagggagttccactattcgctccatgacctgtggcagttcgattttttcaaagttcagctctttttgatatttgttcagcacggctgtgaccaggccccactcatttttcagacgttttggtgatattggcttcgggttcctggcgcgctttcttgatggcctccgggcttccacattaatggcttcctgtaagatttcttcgtccagatcctttaatttcgaatccatgatatcctggaaggcatttttctggatgcagcggtagtcctgtattgtggttggcgaccggttgatagcctcccggctctctatgtaggcgtcaatggcctccgacagggtcatgttcctatactcatggctcttcggccgtttctccttgttaagctggaatagggcggctgcggcctctgcttctttctttccgcgtggcgacgggtcatcagatgtaaaggattcatagacccgcttgcttttggtttttcctgtcttttcatcaatcactttttcagtgtggctgtaggccaggcagcgccaggagcctgacggtaatttttttgctgttgccattatatcatcctttcctattttagggtaaaattaatacgccccttgccaggacgcactctggatgatataatttaggtgtctaaactaaacctatctttccggtagcatccggcaagagcatctatgtgaaaagctctaggggttttcggctcctggggctttttgctgttataagttcaaaagtatctgcttcttactttcaaattcttcttgtgtgatagcccccatatcgagtaattcctttaatgccttgataccttccaatgatttttgggtatccattacaatagactcctttgtatctggtgttgttatatcgaaacaccttagagtggcatcaagcttgctgtcgcatttaaaggatattttataggtcttttttgtatcaacgttgacaagggaaaaaaatgcaattgtacttttttctacatttttttctgtctgctgtagatttgcggttttatgccccttcgttttttccttacctttacttcctgcccccatagcggcaccgacaagtgttccgacgccaggagcgacaaggcttcctaaaagtgcaccagctccgattttcagggccttaccttgctttttagtggtgctctttccgacctcgctggtagacgcattagtaactgtattatattcagggccgttccattcatacgccgagatggtgtaaatatttgatgtgtctgaattaaaataaacggttccatctatccgctgatgtatggataagcctaatgatgataatcctaattctttataaccggaaattggcgtcaatgaggctgaacgattatttttaaattcgttaatatcaaattcttttgtttcaagccaaggctgatgttcattaataaaattaatagtctgaatgattttttcattaacgttgtatccaaaatcaaagcgtatattagtattatcatttcttttaaatagcagaaatccggttttaagtcgagacgcataggaataattaacccctttcataacagaataaggaattgttatcttattcccgataaaagtaataagattaatttcttcttttccgacaaaaagttctttagtagttccttttatactcataaaaattcctccgattaagaattatatctatgctgcgtcatcataaaaatccaactcattaatactctcgttgacagattccaaaatctcatgtttttcaatgtaagaggtccaggccgaagctatgtctgatttgagttctcgcctcaaattgttatataatgtctccattgcttttttccacatctcgccagcggccttttccagctttttgtcttcccagcggtcttttttctgccgctcggcatttttgactcgctggaactgcatggctttaaacataaatgtttgatagccagaaagattcttttctagataatctaaaaactctttgtatttcatatgatcactcctttaaattgtttgctcttaagcgcaatcctattaaacgctcttcataacccaaaatacgcgataattgttcgacagaacatcctgaatattctaataatgtttcatcgcttattaaaaaatccatcccaaatgtatctgcctcatcctcaaattttccggtattaaagcaagtcctagtatccataaatatcatattagcctttttatgcataaacatatggcccatttcgtgagcacattcaaaagcctgctcgtggcgcgataaactattatctatgtaaataatattatttcgctgaaaatactgataaaaggctctcacgtcaatcagtggagcgaatatcagtattacgtttaatccccggataacttcaaatgggtctctgcttcggtgtttccacgccaaagaatcagctaatttttttatatccataaaatcagtcctttttgtacttttttggagtgtacttctccttattctttttcttcgcaagttccataccaatctgcattgctgacaggatagactcgattgcttcgggggtggccggatcaccatcgaacataagtccctcctgagaaaggagctgctctcgcgtttgctcaagaatctttgcaatatctctttcatcttttggagtgagtgtagcttctttcatctttggttcgtcttttcctgtcaaaaggtaatctatgcttacgtcaaaataatctgcaattttctgtaatcgctctgttgtaggcatacttatcttccactttgaaatggatccattggaaaagcctaattctttttctaatttaccctgagatattttatgtgtttttcttaaactttcaatacgttcaaacactgtcacagaaacgcctcctaaatttaccgaaagttttctacaaaaacgcttgacaattagaaagatttctgtataataagagtatgaacacagaaaactttcggtaaaatgctttaataattattggtagcctggtaactacataatagaatattttctgcattttgtcaatagagatacagaatgttttctaatattgctcatgaaaggaggctgatcatgatatatgataaaatcaaaacaatttgcaactctaaagggataagcatacgttctgtagaaaaagaggcaggattaagtaatggtgctatcagcaaatggaatgatgccagtccaacggtagataaacttcaggcggttgcaaaggttttaaaagtcaatatcgaaaaactcttggagtagcaaaacatatgttcgataaaacgactatatcactgtatcggaaatgtgtcaataaaaaaagcgaaaggagtgtgagagagggatgatttttaagaatatctatcaggaactgattctgataagaaaagagctccagagcattcggagtgctgtggagcccaagaaaattgatattaagttcaggggaaaaactatttctcatcaagaaaatcacgattaaaagattcaagtacacgattatatatatcgagatattccgtgtataaatcaatagtgacatttcccttttcctgactttgagcttcgttaacgcgaatttcaaacattttagggaggatagaaaccgcaaaatcatgagcacgtttttcattatcggtcatggtgagtctcctttcttctgtatttcagcatggcaaactgataaggagattgtatcacagggatgggagtaaaacaatatgtcaatgggaaaaggaggcgagagaggatggaagaaaagaaagcatttgaggctttatcgtgcgccaaggaagttgttaaggtgttggaaagacatcatgctacagttaatgatatggaaagagtgcttggtatagtaaaggatatggttttgtcaagcactctagtccacatagaataagattcctgcttaatgagactcgatgaatgtcaagccagaataagtaacacgaacatcagtcagagaaaaatgtggtttgccatccatcgtgcgctggtatgataagccgctcagatatctccgatcaacgcactctgcaagagctgcattaaaatcaccttcatctatagaagaagataaagagttaacagcgataccgtcgcgaatttgaaccaagatgtctttcatagcggaatcaaattctttggttgatttaaacatgatagctctcctttcttatgtactcggcggtgcaacgcctacagtataggtcaggaggctgtgaaaatcaaggaagagaaaggagtgtaagaacatgacagacaagcaaaaagcagccgcccatgccgcctacacccgtcagcaggcagaaaatgttcgagcaattatcagcgaacataaggctcgcagaaatatgaccaatgccggaatcgcgaaggcaatccatatgccactaaggacgtttgaaaagcgaaaaatggatccaggcctttttaaactggaagatttatggctactatgcgaggctttaggtgtaccagaggaacagcgcaagaccattatgtaaaggaggtgataccaatgcacaaacatgattacaccggtgcccaggtcgtccgaatgcggcgtcagctgcgggtagaacgggcagaacgactatggctgtacaggctgctggctgtgtcgttaattatctgcgcagtattgaccggaacgctgctggcagtggcacagacggcagggatgttgtaaggaggaggacaagcatgagcagacgaaggaatggcaccaaccgggccggggctgccatcggcgtaaatatttacaccgggaaactggctccgagaaagaaaaagaacctgccggcggcaaccggacaggctcaggtacatagaaaataatcataccaacattataaagcaaaagtggaggaaatgcaagatggataatagtgacaaaatttatattgcgagtgaaacgtttcaagaactttgtgaattaaaaggtcgtgttacagcatttgaaaggtggctgaatcgcgaacgatattcagtcagcaaggaagattgtgccgctatactggggcttgagctttctcagaaggaggacgaatgatccggtataactgcgacctgtgcggctgctatctggatccgggtgaaggcctgctctgcgacgaatgcagacagaaggtccgggaaaaggcactcagaggtaggagaacacaggggattatacaagaaggcaatggaaaccaggtagaaatgattttacaggaggcggaagcatggttaaaagcgcaactgaattaaaagcaggagatgtcatccgttttgaatatggggactatgataactgggcggaatgcacagttaaagaggccgtaacagtggggaacacggtcaatgtgaagggcagccgcatgggaatgaattatgaattggagtttggcccgaaagagaaagtgcaggtgttacaaaatggagaaactgaaatttaggtgcctaaaggcagatgaaattgactgccggattgcgacagtcagagccaacggtattacactactgctttacaaggatgcccgcgtagaccaaaacatactggatgaaacggtcgggccgatgaactggcagcggcggcattgcagggagaatgcaaactgcatcgtatccatctgggacgatgacaagcaacagtggattgagaaagaagacaccggaacagaaagctatacagagaaggcaaaggggcttgcctctgacagctttaaacgtgcctgttttaactgggggattggccgggaattatatacggccccctttatctggattggagacaaggactgcaagataacggcaaagaagacaggtggaaaagaggcatatacctgctacgataaattttcggtcagccagatcggatatgacagcgaaggcagaatcgacgtcctggaaattcagaatgtcaggacgtgcaaagtggtgtaccacataggttccgggccaaaaacggaacctatcgaggagacaggcaaacaggaaggactgacagaaacacaaattaacacgctgctaaacgaacttgtgcgaaccggaatcggcgtgagaagcatatgcacgaactacaaggtaggccagctctcccgtttgaacatggaacaatttaaagatgccatgaatcagctacgggagaagccggataaagtgcagaaaaaagaaccagatcccgagacgatcccgccggatgatgactgtgggctgccgtggaattaaagaggaggtagaagcatgaattacttcaccgatataaccggttatcgggcggccggggacggtgttgacctgctggtccattttccccaggatatccgataccttatcaaacgccagaatatccgccacgcagaagtgattctggatgatggccgccatatctccatcgaacagcgtaagaagatatatgccacgctgagagacatcagcgactataccggagacccgccggaagtgacaaaagagtggatgaagtactgttatatcgaaaagacgggatgccagtatttcagcttatcaggctgttctgtgaccacggcaagggagtttatcaatttcctgatggatgtctgcctgcgcaacggaattatcctaacggagagcggcctgaagcgtacggacgatatcgatgcatatttaatccagtgcatccggtataagaaatgctgtatatgtggccgccccgcagacgtccatcatgtggatgcgattgggatgggaaacgaccggaggagctatgacgatagtgatagcgagattattgcactatgccggggacatcatgtacaggcccacaatcttggaaatatccgattcatggagcggtacaaggtgtacggaatcaagaaatatcagacagtagaaacagaagactttgggagcttcggagaatttatcaaggtataatgccgcagggattatacatagcaactatcaactttcatgcactttttaggttagtatatcacgatacgatgccacttaagcgtaacgggcggtcagaccgaggctgcccgtatcctccggaggggaggcgaggaacatcaacgaatttgaagtatttacatatagcgtttataacgccctgggaatcggccgtgagaacgcccagacccgacaggagctgtgtcaaaaactccggtgcggggatcgcagcctgaggcgggcgattgaggctctgaggcaggattatcctatcctcacgcaagatgacggccggggttattatctgccgccaacgacaccggaagggcgtcaggaggcgagccgatgggcagccaggcaggacaagcggattaagagtatccggatgtcccagagaggcgccaggaggtttgcaggaggcgcgaggagcaagggagtgcctgggcagattagtatgttcggcggaatgggcggtggatgatgcgagacggaattgttttttacaggagtttttacaacgccataaaggagttgtcggatgccgagcttgcaaaatgctttaaggcgattatggagtatggtctggacgggaaggagccggagacatccgggatagaaaaaaccatttattgtctcgtaaagccacagattgatgccaataataaacggtatcagaacggaaccaagggaggcagaccaaaaaccgaaccagaaccaggcgataaccaaacagtaaccaaagagaaaccgaatgataaccagacagtaaccaaaccggaacctaaagaaaaagagaaagtaaaagagaaagataaagtaaaagagaaagataaagagagtaaaggggctgtgcgctttgcgcctcccacactggaggacgtaagggaatactgcctggagcaggaatatagcattgattctgaacgctttattgacttttacacggcaaaggattggatgatcgggaaaaacaaaatgagggactggaaagcagccgtgcgaaactgggcacggacccagcggcaggaattgaccgccaacgggagcaggaggcaggaatcgaccgccaaaagcaagaaccgctttcacaacctggaagaacactgctatgactatgacaagatagtgtgggagatgatgaacggtgaaaacgaaggagacagtaaaacaggtaattgttgattacatacaggagtatgattacgcaccgtctatacgggagattgcggatatagcttattgtgcacagtctacggcacatcaatacgtacgtgagttgttacggtccggggaactggaaaccagccacccgggaatgcccagagctttgcggctgcccgagcgacgctacaggattgacagtagggcgcttaaggaggtcatagtcggattggccgggtgcgatggggaggacgattatgccagaggctgggatgatgcttttgaggcaattatgcgggcaatggacaagatgaggatatgattacctttgagccattctgggaaacgctgaggagaaaaggaatcgggtttggagtagcggatgattacgtgtattgtccacactgtggggcggaacttgattggaggcatgtgcgtatgctgacagaaagatttagaaaattggcggaacgattgtagacattgtgctgtcctatccaggcaaaacggggcaaggagagcgagaaaccttgtaaaaaatctctggagtagaaaccagataggaaataaaaaagagcagagagctgataacgcaagagagcgcaacgggtgcgccgttaccagaagcggacggaagccaggtccgttgttagggcataggccgaagccggaatgccggtactggcaattttttataaattgacattttaggaggaaaaaaatgaatagaaaaacaaaaaacaagattaaagaaggtgggctggttgcagctatggttattgttgtactgattgcctgctatggcctgagctggatcgttacatgtggaatcattaaattaatcaccatgtgtttcggttggacattcaaatggtctattgccactggaatttggctgattatttgcatattgaaaagcatctttaaaacaaccaatcaaaattgacaaggaagtatatgaagattttcggaaggaaggtgccagatgagaaaggtgcaatggtgtgtaaaatgtaaaaagtatcatctttttgatgatgtaaactggaaatataactggaaacagagaacatgggagtgtttgaaaactgaggatttagaggagggatagaatgacattgagaacacctaaaccgacgagagaagaaagagcagctatgacacatgatgaattactacgctcgatatggttgctggatgaagtaatagagttgtttagatggatcccggtggaagagcagttgccgaaagcgaaagaagatgttttggtttgcacaagaaatgggtggattttgatagcttggtatggtccaaacgggcaaaaatggcatgtaactccaacggatattaagcaagacgacattatcgcatggatgccattaccagaaccatttaattcataaaatgaggatttaaaggagtaatatatgagatcacttttatcgacgcccgcattgaatgaaaagatttgtgatatgaaggaccggagagagaaagataatacatggagtgcagatgacgagcagatacttgcttttcttgtcgagctacatattttgcgaatttctaaggcccatgcggaaaacgaagccaagggaatcacagaaacaatatataaaatacatgatgaaatgcaggacgagagagggttactagtacgttaaattgacattttgaggagaacgctatgaacgaaaaaacattacagtgggctgcaaagcagttagagcagctacgaaagccggcattgttaaacagagccaatggtccatgtgtatcatgtaaatttgaacctgaatgccaatgggcgcatgagtttgatgtggaggactgcaaggattgggcggcgaaagaggaggacggggaatgaagagaaaacggaataggcgctgtcatgcaaaagggaaagtaatagtatggcctggtcgtatggaccggtgccagaagagtgattgtaaaaagtgtcattgctattattagcatttaagccaggaggtaattatgatagtttgcgaagaatgtaagaagtgcagtaactatatggtatgcgagaatggctgttatgggagtgataggccatgcgaatatcttgtttcagatacagataattaggatttcagagcggtggagcaggaataaaggggggattacaacgagcaagacagattacataaaagtggcagagcagcggcgccgtcgggcatccgcccaggactacatcctgaaggggccacggccggagacctggtcggcggtgatgccggcatattgttacacggtgctatgtccggtgccagagctgcgggtcaacactggtggacagataggaggcgatgacaatcaaaaataagagcaaaacagagctggccttaatgggagctattttcctggaggatattgataagtgcagacaacgggtcaagataggagatgcgtttaatgtggccgacaacgcctggaaatgtgagaagggcaatggtgtgcggccagttatgcgtggccgggtgacggctaagtatccgcactttgtgatacttgattgtgggacatccattacatacgttcagattatccaataccggcgcaagcgtggtcgaaataaatttgtggattaatgggggtggtgccagtgggaattaagataaccaggaagctgctggatgattaccggcgcctgaagcgggaaatacctctcctggagctggagctggtcgagatgctgcagggggataacggtttcgacaacagcacaatctttgattaccggaccggagaggcgataccccagagcgttgtgggatttgactggaagctgcgagggcatcgcgagaaggtattggatgggaaaaaggataaggtcaaagcggttgaaaaatggattgaggccatagaggacgggcaaacacgatgtgtatttaagatgttttacattaatgggatgacatgggacaggattgcggcaaagaccggatatagcaacagtccagattatccgcggctccatattagagatgactatttaaaaaagtgccaaattaagtaaaaggtcgtttaagtcggaaaggtcgttgtagaatacaatagaagccaaaggccttaaagccagcggctcccctccccttttcggtcgccagtgtgtaacagcctggtggtcgattcgccggtatcgcgtaacccctcataagccaggctctattaacgggcaatgccgcagggcacgcgtccggcactatatgtaaaatgcgaatgtaaggtgaacccaccgcagggggaaccgatgaaagaaatcctctccgatgtcagccggcgaggcaggcagtgataagtatatagcaaggccgactaaagtacggtgaagcgcaagctggaaacagtggccgagcgaaggaacatgggagacgtccctgggcggagttgcgaggggctgctgatgccaatgcggactggtcaaaaagttacccttaattgaccttaccaaaaacaatacagggctatgccgggaaaccggcacatgtggagcatcccaccaatggcaggtggacaggggcgcgccctgggttccggttcgattccggatgcgccgcttgtatctggttttatctcccaaagacatttccagatacggattaggcacttggcttatggctgagtgccttttctattcctttttggtatttgaacaattagaacatatgttctatactgattatacaaaataggcgtcaataatatgggaagaatttccagaaaggatgtggtataatgtaaaaaaatgtcgatgggagagaagcacaatgccgtctattggtttgtctatttattcactgagggttttaagattccgtggagaagatgctgagttacataatttgaaggatggaaaaagtctgtttgattttgcaaaagagtttatcgaaaacaatatggaaaattatgttgatgaagaaggcaacgaaaatatatttgcattttcagattgggatatacgtacaataattgaccaaaatagcaataagctttatactctactttatggtagaattaaatcgggcagttatggctcggagggtgaacttgtggacaaggaaacaggaaaagtaacgcacaagattacatcgaaggaggctccagttcttccgttcagcttttgtatttcggttgctgattgtgagaaagatgacggagtaacaactgccatagctatttttcagaatatcggaggaaacggagttaagactattttcgaagaacacttcaaggcgtttttaaaaaagcaagatataggtttaacactaagtttaggtgctttatatccaaaggagtttataaaagcatatatgcgagaggggaaactggctaaaataaatatgattcaatatgctattccagatgacatcgcagatcgtgtaggaatgaaccggggtgttaagagagcaaagcaaatactgacaattatgaatcctgtaggatttctgagcagaaatgagtataaaattcatgaatgcatgcaagggaaaagggcatatgataaaataatagaatttccagattttgactatgatgatttgaaatttgtttttagtatagctgggaaaaatagaactgttagtatgaagaatattgacaaaaccgttgtcgtgaaagatattacagaaattgtatcaaagataggcgggaatccagaaaaagaatcaatcattgtattgtttgaagagtattcacgggaatatctttctgatatgggacttataacgcttcaagaaaacatggaatataaaatgatggtgaaggaaaataattcgaataaagaggtgaaagcaaatgaaactattattgaggggggtgagtgatcccactatttggattttactatgttttctagtgctttttatctcaaaagtaatttttaaatcgaattactttaatataactaatattattgttaaccatgtagatgcatttagaaatgaaaaggataataaatttaataaacctcaatttgtaatagcctttattgtgcctgttttttttgcgggagcttttgcaaagattagaatagtagatgaagacactataaatattcttacattaataatttctgttttaacttcaatgttctttactttattagcgatagtgatagatattaaagcaagatggaaagagaataaaggaaataaaagctcttctgaaatgagcgtaatagggagaatattgcagacggtttattatgcggtcatgtttgagatattactttctataatactactcatattgtgttttgtagcagtatttactgcaaaattttcatttctgcaaagcattttgatatattggttttcaaatatgcttataatgaatttgtttatggtgttaaaaaggatatttatagtgatagatagaacattaaagtagatatattatagctagaaccaggagccacccacccgtggctctttttctatacccaaaacaacacgaaatgaggtgagaaacatggcccgagcgccagatccacgaattgagcaggcgaaggccatgtacctggaaggcaggaaattagttgagattgcaagtcaactaaatttgccagaggggacggtccgccgctggaagtgtacacacaaatgggacaacgaacgttcggataagaaaagcgaacgttcgcaaagaaagaagggaggccagcccggtaaccagaacgctgttgggaatgaaggtggcgcccctgacctaaataagaacgcagaaaaatacggtttcttttcgaaatatcttccggaggagaccgtttccatcatccaggagatgcccacggacccgctggacattctctgggaccaggtacagatagcctatgccgccatcatccgggcacagtccatcatgtatgtgagggaccagaaggacgtgaccatcactaagataggccataagaatggggagacggtcacagaggagcgccgggaagtacagcaggcctgggataagcatggcaatttcctgcaggcgcaggccagagcccagaagacgctggaagggctcatcaagcaatatgacgagctcctgcacaagaactgggaactggccggcgaggagcaaaaagcaagaattgcacagctccgggcccagacggataagttaactgggaacaaccaggagctggaggacatggaggggatagagggggatatctatggcggcagtaaatagttttgtcaggaaaaagaccatcccattcaacttttccgagaagcacaaggattatatacgtaggtgcgaggcctgcatgtataacgtggcggagggtgcggtccgtgccggcaagacagtggataacgtgtttgccttcgcccatgagtttaaaaccacaccggaccggattcacctggctaccggttccactatggccaatgcgaagcttaacattggtgatgccaatggctttgggcttgagtggatattccgggggcaatgccactgggggaagtacaaagacaatgaggcgctgtttatcaagggcccggacacaaggggaaaacagaagatagtaatctttgcgggagccgccaaggaagatagctacaagaagattcgtggaaactcctacggtatgtggattgcaactgagattaacctgcatcacgataacaccatcaaggaggcattcaaccgtcagctggctgcccggcgcctgaaggtgttctgggacctgaaccctgataacccaagggcgcccatctatgcggagtatatagacaagtatcagcgacaggcggatgcaggggacttcccgggtggatacaactacatgcactgtaccatctacgacaacatcaacatcaccccggagcgtctgcgggaggtcgaaagccggtatgataaaaacagtatctggtacctccgggacatcaagggaatgcgcgtggtggccaatggcctcatctaccgccggtttgctgacgacacaagtaccaggcagtacgcgttccgcctgacagataagcccaaagacatcatggagattatccttggcattgacttcggcggcagtggttccggccatgccttcacggccacggccatcaccaggggataccataacgtggttgcactggcatcagaatggattggttgcaaggatgagaaggggaaccagatagagattgaccccgaaatgctggggacaatgttctgtaacttctgccagaagataatcagcaggcacgggtacatcacaacagtgtatgcagacagcgcagagcagacgctgatagctggcatccggagcagcctgcgtaaacatggacttgggtgggtccgtgtagagaatgccctgaaaactgaaatcaatgacaggattaacgctaccgccatcctgatggcccaggggcgtttttattatgtccagggcgagtgccagagccttgtggatgcattgagtactgcagtgtgggacccaaaggaattgacgaagaatgtccggttagatgatggtacaagcgatattgacagcctggacagctttgagtatacgtttgaacggcagattagcaggctcataaagtatggataggaggtgatgggacgatgagattcacaaagatgctggacttaatcacgaatgtcctgaataaggatgcggacacgcaggtggatgtgtgcctgacatcccggatggcgaaccagatagagctgtggacccggatgtatgagaaccggtccccctgggtgaacaacaaggatgtgttcagtgcaaacctggcaccggctatcgcgtcggagctggcccgactggtgacactagaaatgaaatcagaaatcacaggtgggaatgactccgggtatctggatgaacaatataagcgaaaagtcctgaaaagtatacggcggtatgttgaatatggatgtgccaagggcggcctggtcatgaagccgtatatcacccaacacggtatcgaagtgcagttcgttcaggccgattgcttcttccctatctcattcgatagttccagccggattacacagtgcgtatttacggaacagtttcggaaaggaaagaagatatatacccgattagagattcactccatgcaggccgggagaatccggattataaaccgggcattcgtggctaccaacgactacagccttggtagcgaagtgtcagtcaacagcattgaccgatggtcagaactggcaccggaggtcacattggaaggggcggaccgtctgctgtttggatattttaaggtaccgcttgcgaatgctgacgattccgacagtccgcttggtgtatcggtgtattctcgggcgattggcctgattaatgaggcagacaaacgatattcgaacatctgctgggaatacgaaggcacacagcttgcggtacacatcgcgacgtcgctgcttaagtacaaccgggatcgtgataaatttgaataccccggaggaaaggagcgcctataccggaatctggaatataacacgggtgctgctgataaaccattcattgataccttttctcctgaaatccgagacactgcgctgttcaatggctttaataatcagctgaaattagtggaatttaactgctgcctggcatatggaacgttgtctgacccgcaaagcgtggacaagacagccacggaaatcaagaccagcaagcagcgatcctacgtgatggtatcagacacgcagatggcattgcaagatgcgttagaggatctggtgtatgcgatgcgcttttgggcggaactttatggattagttccagccggtggaaactacgaggtgtcttttgactgggatgacagcgtcatagtagataccgaagaagaccgaaatcaggatcgtaatgacgtggcgatgggagtcatgaggctggatgagtaccgcgctaagtggtatggggaaacgctggaagaggcggccaagaacctgccggaaccggcactgacggaggagtgatgtaaatgacgccagaagagctggagaagctgccaaaaccgattgagcgaaccatgacaaccctggagctgtcaattatgaatgagattgtacagcgcatcaaggcatccgcacagattactccggtaacggactggatgttgaaccgacttaccgcaatcggcgttagtaagtccaaaatcaaacggatgattgaggaggccatcaaacaagctggactgcaggtggatgatatctacaagcaggctgctcgatctgattacatccgcaaccgagagatatatgaggctgccggtgttgactatcagccatatgaggacaaccaatggctgcagcaggttgtggatgctgccaggcggcagaccaaggacagcttgaggccattggaaaatatcacccagacaacgggttttaatgtgccgatgggcggtggaaagaaagtatttacgccactgtccgaatatctggagcgcagcctggataaggcaatgcttggaatcactaccggcaccaggacgtacagccaggccataggtgaggtgattgacgagatgacggccagcggcatccggactgtggattatgcatccgggaagtcagaccgcatagaggtggcagccaggcgtgcagtgatgaccggtgtggcccagatgaccaaacaggtcagcgacaagaacgctgaggagctggggacggaccattgggaggtagactggcacatgggcgccaggaacacaggtactgggtaccttaatcaccagagctggcaaggcaaggtatacagttctgaggagatgcggactgtctgcggcgagggtgagatgctaggtttcgcaggcattaactgctatcatattaagttccccttcctgcctgggatatcaaagcggaagtatacggatgagtggttggcggaacagaaccggaaagagaatgagaagaaaacattccgggggaaggagtatgacacctatagcgcattgcagtatcagcggaagttagagcgaaccatccggaagcagaaacaggacgtggaactcctggagaaggcgggagctgataaggatgatataacggctgccaagtgtcggttgagactgaccaataaggcttatgtggatttctctaaggagatggacatgcggcaacagagggagcggctgaggattccaaagtaaaaagttgcgatatcgcaacggaaagagaggattatatgattattacaggaatgaagcattttgaaaatgtatgccagaagaaattggttgagtggtatagaaaaaatagaccaggggttgaaattgacttgggcgatgtatttattgtttggtcatgcaagactttacagaattataagtgtcttgcatctacgacaataagcggagatggaatctatgctgaatatacgtttaacggcgataagcaagaattgtatgaagatgtgtacaagaaactgacaaatatttgccacaaagaggagtaagcacgcgggactaccctgggtgctatttttacgcccaaaattgcccggaacggcgtaaaactaccaccacaagggatgcaaccccgtagaaaagcgtagtgagaaaggagcaatatgaaacgtaaatttttagaggacatgggcctggcgaaagagcaggtagacagcattatggccgagaatggcaatgatatcgaggccatcaaacaggagcgggatacttacaaggggcagctggagacggcgcagtcaacgctgaaaagctttgagggcgtaaatatatcagagctgcaaacgaaagtgacaacgcttacaaacgaccttgcaaccagagaggcagagtataaaaagcagttggcagaccgagactttaatgacttgctgaaatccacggcggaaggatttaagcctagggatatcagagctgttatgcctttcctggacgtggaaaaactgaaatccagcaagaaccaggaaagtgatatcaaagcggccttagaggctgtaaaaaaggacaacgggtacctttttcaggatgtcacaattccgagagtggttgcacccactccggggcctggcggagaaaaaacagacgatacaaggacacaagcaaacaatgccctgagaagtatcttgggcagagaataaggaggtaaacaatatatggcagtatatattacaagcagagccgacgcggaggccattatccgcgaacaggttatttcaactatttttcaggacgcaccgaagcagtccacattcatgagcatggcgcgtaagctgccgaatatgaccagcaaccagacccgcatgagggttcttgacttcctgccaacggcttattgggtggatggggatacaggaatgaagcagaccagccgccaggcatgggacaacgtattcatcgaagccgccgagctggcagttattgtgccgattccggaggctgtgctggacgatgcggagttcgacattttcggggagattactccaagagtcaacgaggcgatcggccagcgagtggacagcgctattattttcggtgtgaaccgtccgcgtaactggcagaacgatattatcacactggccagacaggcgggaaataatgtggcagtcggatccaatccagattattacaatctgctcctgggcgaaggaggcgttatttccaaagtcgaggaggacggctttatggcaaccggagctttggctgccatgagtatgagggccaagctgagggggatccgcgcaacggacggcagcctgatttttaaatccgatatgcagggttcaacaaactatgcgttggatggggcaccgatgtacttccctcagaatggtgcttatgacaatactatcgctcagctgattgttggtgacttcaagcaggcggtatattccatccgtcaggatgtgacggtaaagattctggaccagggtgtcattcaggacccgactacgaaagaaatcgtctataacctggcacagcaggatatggttgcactgcgtatcgtattccgtatgggatgggcgcttccaaacccggcaaccaggatggacgaagaccgtgtaggctgcccgtttgcttacctggaaccgtctacagcggtaacaacccagaaagttacatttacagtaaaagacaaagatgaatcatctacagcaattgcaggcgcgattgtagacgtaaatggatctagaattaaaactaatacatcaggtgtggcagaatttaaccttcgcgcgggaacatatccagcgaagattaagaagactggatatggcacaatcactgagactgtaactgtggaagcagcaccagtggaaaagacggttacactgattaagcagtagaaaggaaggtgtgctgatgacttatgccaatgaaacattttacagagaaagctatctcctgggacggaagccagtcatcagcaccggcttcctattttacgcccgtcaggccagtcggttgattgaccagtacacatttaaccgcctgaaagatgcgtcagaggcttcggaagaagtacagatgtgttgttgtgaactagccgaggcagaattccgcagggagaggcagctgaaagaatctggcgggaaggctgccgagaggattggaacctactctgtcagcttcggttccgctcaggagttagctgcagcttccggccgggaacagcgggaaatcatcatgaagtggctggctgataccggtctgtgttatcagggggtgtaatatgtataccaacgcagattgcacgctgtatctgtacagcaaggaaggaaagaacgagaaatacaccaggttccctgttggaggagtgtactgggaggatgtggagcaggccaccttcctgaagaccggacagcggaacgcctgctccgtacttctggttattcctctggaaagcctgtctgagccggttaatttcacgaggggaaaagaccttgttatcaagggaattgttacagacgagattgactgtaacagccaggaggccatgtcaaagtcactggcggccttaaaagcagcgcatgagctgctaacggtaactacggtagatgagcggttgtatggcagcgagtcgatgcagcattatgggctgtcctgtaagtaaggaggcggcgaggtgtttaacggaagtctggagcttaaatcaacaaactttatcctgaaaaaccacggaatccagccaggcggaccagtgcagaaggtgatagacagcgagactatgcggtatatgggtgattatatgccgcgccgtcaggcaggagaattggaacacatgatggtactgtccaccgtcatcggctccggacagatagacattccgggaccatatgcccattatttgcacaaaggtatattgtacgtgtctccgacgacaggcagctcctgggcaaagaagaatgaaattaaagtaccggcggagcgagagctgacttatgcaggcgcgccgatgcgaggcaaggaattcttcgaacgcatgaaagccgaccatagggaagatatcatccaagcggcgcaggcattgatagacagaggagggaagtaattgacaatcatagattttatgaggcagaaactgacggaatatccgaaaatatcagagtttctggctggcgatgacattcacatcgacttcacggacccttcccccgtcaattatggcctgtccagtaccggagacagcctggtcaaggaggatttgctgggaaaccagatacggcagcataattttgtcatgtatgcggttggccaatcatttacggattataaccggttggccaacagtaattttctcctggagctggcttactggctagaacgactgccggaagaggaaggcatatccggcacggtggagaatcgggagtttctggggaaatttatgaaagtgtccacggccaatgccatgagcatgggactgatgggagaaaccatagagcagggcgtcatgtatcagatacagatatacgcccaatacaaaatagaaagtgaggaattataaatgccggatgtaacgggtaaaatcaaacgaaaatttatggcacattatattgattctgcgcttccatcggctagtaaagccgaatattcccgacttgggaaagatctggaagaatacacggtagaaatgaatgcaaacgtggagaccaaaaataatattttgggtgagacatcggttacccttgacagctatcagccacaggcttccacggatccatattacgcagaagtcggagacccattgtttgtacggctgcaggccattgtagacaaacgtcaaacgctggatgaacttaagaccagtgtggtggaggtacatctttgggaaccagttgaatcagcggaaggtacctatgtggcctacaaggaggatgccgctctggtaggcagcggcggcaaccgcagactgctgttggcttcgctgtacaatcgagatttcgttgtgtggacagggcatttcgtgtccctcctttcggtaattggtggatggggtggcgttttaccacctcatttggggcagaaaaaaagcaggagaccttttcagatttcctgctcggtggtgccgccggtgggcggctggtattcagttttgaaagttcgggtcagggtggcccgatgatgaaataaaatatctgcatgaagattattcaacttcttttagtaattcttcaacagaaataccgtaaagttttgcaagtgcaaaaagatttgatgtggaagggtcggatgttccattttcccattttgaaacagcctgcctgctaacaccaatcgtttcagcaacaaattcctgcgtcattttgcactgtgttctgtgtactttgagtgcttcacccaacgatttcctcactacggatttttcctgccgtacatcttttgaatggatatatttgagtaatgcacgaacaataagggtaagcaaaccaacaaagatacataagaaaattattccaacgattatcataaatacggttactttcatttgaccacctcctaatgttgctgttggcttcatttctctgtacggatatatttaagcaatgcacgaataacaaggataagcaagccgacaaagatacatgagaaaactattccgactacaatcataatgatgtttactaacatttggatgacctcctttctttgttggctttattctatctgaattaccgtgttgctaccaccaactatcaagcaattatcagttgcatatcggttgcacaatgatagcgttctgttttttgaccttattatactaaattaccgtagataaggatagctcgactgataaaacttgctggacgggaacagcttgcagcgcaaggtgtttccgggcggcaagtccacaaaagggtagctggcgacagccagcgcaggggaagcgtagcgtcccctgtatgatttggagcagaccatgactgcggaaaatcacagccctccggcgaggagccttcggagaacgcaatgcaccaacctttgggtggtgtataattgcgcccttagtaaactaagggggttccggcatctcccgttccagcagttttttcaatagttcctgcgtgtcctgtctgtgaaaaatgagtttcaacaacagcatgacatcatcatctgtcaggcgttccggttcttgcagaaaactttccagcataccgccacgtgtacagagccggtgcgttcgttcttttcgggtaagctgcttcagctgatgctgcaatgccttttcatcattgatggctttccgcagtttcttttcgcttttttccaactcccgattgagtttttccagctttgatgtatcaggcaagggcagcgtcctcctttcccggtatcagcacataaatcctgtttggttctccaatgccctgacgcacccgcatgataagtccggcagtttccagttcattcagagaacgcttgaccgtcatggagctgcgggacaggactgcggcaatggctgtgacagggaagcagacaaagaggattccgttctcgtcctcctgccctttggagagcatagcgtccagcatccggcagtacatgacctttgcggtgctgctgactggaaatcctgtcaacgctctgggaaaaggcatacagggcggcaatggtgtgtctatcgtcataaattcaaaattcattctgtgtgttcctcctttttctttgctcgtttggataaataacaggggcagtcaatcacaaccgcccggaagctctgcttgcacccatgctggcatttccggcataattcgttgtaagtgacacgcccccggtcattgaggtaaaaggaaagctcatacttcctctttttgctcattctcggcatattgcgcttcctcccgttttagtgtatggtttcggggcgattttcggtaaaattacagccatagagccgcttaaaatctcccgaagtatcagcgatagggtagactgtccccctatcagattgttgtgtttcggtatcatttcggtgtcagttcgccagttctccccggtgtcgttcctcccctgaatctcacagcggcgtatcgctccctttggtacgctcgttttggtcagggttcctccatatccctgccaaaagtcatgacgctacatcgccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgttagaaagggggaactgcttcaatgaacggagctactacaatacaggaacggctaaaagatttacgattaaacaaaggattaaaactggaagaactggctgagcaaacgggtatttcaaaatcggctcttggcagttatgaaaaagacgactataaggaaatcaatcatggcaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctgtgcgaacttgccacccataaggactttatcaagtttcttgcggacattgagatttatgtggatgggattgccaccatgcagattcaaaacctcaacgcccttgtcgataccgtccggcatgaaatcattgaacggtatcgccccggcgaagatgacccccatttgaaagtgttgcaagccgcccatatcagtgatgatgaatatttcagtcacatggtacgggatgacctcaacctgattatccgggatattcgggaagcccataaaaaggacagcgagagtgcacctcagaccaccgttgccgatgaactgaaagaaaatctggaagcggttgaaaatttcaagggcagccgtgatgaaaagctggttgtcctttactgtaagcagcttggtatcaactataaaaatctgtcagatgaagaatttcgctggctgattcggattctcaaaaaatcaaagaaaatgggaacgcctatcagccagaggaaaaaacgataaagaaaaaccgctgttgcatggtttgttggcttccatgtagcagcggtttttgctgggattattcagttgaatttttagcacgacaaactggaatttgtcaaagaggattattccaatattccacagtatttctatttacatcataaaaagtaatattacccgcatttataggcaagacaatcgcaaaaggtttattgcggtcaatatcaaccacttgaattgtgttgccatcatctatttcaagttgttgcacctgctgttgattcatagaaataaatgctcgttcattatatccctctacagtaaactccacaattcctctttgaatccccgaaagagttccacctccacggaaaaaatatccgaaggaaagtcctggacgattgacatagacggaaaaagaatggtcactcaaatcctgagggtaagaaatatatgcagccatcgtgctggaaacgcttccatcgaccgtccaatcatccttaatcttctgcgacgaacgaatatctgcctccagcttagatgaagtcacgccgatctcattgttcgtataaagaaaacaaacaaataaaatacaagcaagaacaacccctatcacaattttaagaaatatttttttcgatattatttttcatttttttaaactatttaatactaatgtcttttataatagcttttcatatattatataatcaatctttataagtccttttataaatttcttttctaccattttcgataaattcctgtttaatatttttaattccataaacaatagtttcaataggataatattcttcaactatatcttgatattcttttgctttctcaatatctatatttccatacattcttaatatatcttctccaaaatttgttcctatttcttcttcactatcttcaagtaagtatataaaatcacaatattcatctataattccagaatctccaaaatcaattattccagttaatctattattgccatctaacaatagatgattacaactaaaatcattatggcataaacactttttaccctcaaaaactgttgttgcatttagtctttccataaaactttctatataatctttttctatatcagttaaatcattataaatagtttcacgcaacaatatatactcttctaatacattttgtttattatcaatagtacattcactaatatctgtataatctaaaccgtgcatttgtcttaaaaaactggcaatatctcgttttaacaaattttgttcttcttctgacatagtagaataaatttctggtgttaaaaaagttcctttaatttctttataacctagtatagataattcatcactaatatacgaatattcaatattaggaatttttacattagtttctaaatttgtatttaaaaaattatatattgctttttcttttgcataaccttttttcttattagtactaaattttgttttaaaaatgtattcattattaactaaatatgccacactatcataaccactaccgattatttcaatactatctactttgaaattatcaaagtaatgctcaattaaatatttcattgccttaacatttgtggcattatcatcatatctatattccattaaataacaatcttcttttttgccctcgtgtaattcatgttctggcaaatcttcaataattctaaaaccagatttttggtatgcccttattgctcttggattatttttatgagggtctaaaataactgcattagcatttctttcttttttcaaaaattcaaaaatcaatttaatatatcttgtaccaattcctttactccaataatttggctctcctataaattgatccataccatagactatctcatcagtttttggataatgataatcagtatataactcatcatacattttatatatttgtccatatccaataggaacattgttatattcaataattactctaaaaacttcatcttcccaaggctctgtataatgtttttttaatgattctaatgtatattttttatctctaccaccataaaattctaatactctttcatcagttaaccattttaacatcaaaggaaaatcatcatctattaaagttcttatacatatttcattttcaactatattcatttatttatcacctttttcataatcatatacatatactatttcatctttataatcatttttaccacctaatttttcatatacatggcaagctctaggattacctttatcagttattaaaaacatttcagaacaaccaatctctttagaatattccttaataaaagataataattttgaaccataacctttgtcttgatagttaggtaacattcctattgagtgtaaataaaacattgtttttccatcaggtcttaaaagtgtatagcaatatgcaaatcctataattttattattttctttagctataaacccaaatgaactggtatcattaagaaatccttttaaattatcaatatcaaaaaccatattatcatcaattaaaacttcttccataaactttttttcacgctatcaaaactccttgtcaactttcgatttgtcataatcattctaccataccgttatgaataaatcaactcttgcaaaataatttcttctgcccggttgtgaatgttattgcaacgctgcacccattccatttgatgggtacgcttcaattcctcggtcacaccatcggcagccttcatctgctccatgatggtgtctaaccgttcctgtgcctgttcgttcaggtctgcaagatatgtccataactccccggtcagtgtcaatgtgttcaatctggctgggtgggcttctcttaaatattcccggtgcatccgtccgtactttccgatagggcggtgttcctccggcagcttcaaatctgggatatagtaatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggccaatgtatccatgctgatgtgctttccctctttgctcatgttggcaatcatattcgttgtcataccggcggcaagccttaaatcttcttttctcatatcacgctctaacagtgtatgccagagtggtttatagctgatgtgcatattgttttcctgcctttttatccataccaccggggcggctgccccggcaggaacttttctcttattataacaccaatcttgtgtaatcacaatttattcttgtatcctgccgctgataccgtctggattgtgcttttcctttctttttgttccctttaattagccataaactgtttgattccctgtgatttcgccgccgggttgtccgagccgtacccttctaacaggttgatgactccccacaccgcaagcccggcccccagggcgataacgagaacctttaagatgtcgatagcagagttgaaaaattccatgtggtttcctccattttcttagattgaatcggttttcgggtaaaaaaatatccgcccataacggcggcgcttcgggccaatgtggcccgaggtcacgcaaagtcgtcactgtccatgtcgtcaaagttgagaatgtcagcttcttcctctgcgtctgtttcctctatctcgtaaaccgtgtattcgtcctccggctttagtctcaatggccggtggcggaacagggtttccaagcggaaggcgtttttctttttgtcgtactcggctgtctggtgataattggggtgctttttcaagtcatatttcgggctgtaaaaaggcgggaggccccggagctggcagatacacatatttccgggcatggtggtgatttcgcttgtggtgagaagctcccggcccagacgctgcatgttctgcccgtagctttcggactgcccccgggtgcggctttctgtctgcatggagatagtggcctttcccagccagttttcggaaatgtctttcagtgtggaggcttcacggcccccaaggaacacgatggaatccatgttccccatgattgtctcggcgttgtccttatagagcgccttgcactggctcatggcctgatagaacagcgtcaggctgatttcgcgggaacgaatgacggccacgattttttccagccccggcacctgtcccgtgttggccgcctcgtcccacagcacccgcacatgatgggggagccgcccgccgtacttgttgtcggcccgctcacagagcatgttgaacatggtggagaaggcaagggcaacgaggaagttataggtggtattcgtgtcggatatcaggaaaaacagggctgttttttcatctcccagcgtatcgaggcccagctcgtcatagctcataatctcccgtagctctccaatatcaaagggagccagccttgcaccgcaggaaataaggatagattttgctgtcttgccagagacgaaaagtcaaggactttttcatcaaattcacaaagaagtcacattttgcggacttcttcacggagcagacgcttgattttgtcctccatcgtctcctttgcggtctggctgaaatggacacggacgatataggtggtcttgccgatttgctttctgacagtcgggcaaggggtgctgttggttgcggtattgttcattcaaaatcctcctctaaataaaaaatgcccggtgacttttcatcatcgggcggtgatcggtatgggggaagaaggcaaggcggcaacattaaggtatctataaaacctttgccgtctttgccacgcttgccttgttcctgtgttactctcggagatggcaaatccatgctgtgccgtctttctcggttatgagcctgtctccgatacggcttttcgccgttcgcatggtgcgtgaggaaatccctcggtcattgaccgctttttccagctctgcacttggcatacgctttccatctgcaagcagttccagaatgagcatttgcgcctgtgcggtcttgctctcggtcttggcggtgtctgtcccggcaagaagctcgtcagcggtaatgtcataagcccctatccactcaaagcctttctcgtctcccagagaaaacgcaagggactgtccgggcggtgcaagggagcttttctcatggataagcaccctcgttgtggggctgtccttcagcttgccgataaaaagcagactgcggactgccgccgtaatgtcgatagaccccaatccccggtaggtgctttgcgttcctgcggctttgttgaggtgtccgatcagcacgatagcgcacccggtagcctgtgcaatgtctcccagactgcggaatatcgggcgcacctcgtttgctctgttcatgtccacatctgcgcccagaaaagcctgtaccgggtcaatgataaccagccttgcgttgttttcccggattgcccttgcgatgcgttcatcggcaagggtcagcggcgtgtctctatcgtcaatgacaagcactctttcaaggtctgcgtccgcttccatcagccggggcttaacggtatcgcccagaccgtcctcggcggtctgatagatgatattgaaaggctcaagtgtctccataccgggtaaaggctttcgattggtgcaagccgccgcaaggcgcatggcaaagtaggtcttgccctcgccgggattgccctggataattgtcagctttccaaatgggatatagggaaaccatagccattccacgctcgtcagctccacatcagccatacggagcattgggacaggctgggcggtgggcagctctcgcagcgtgattgtctcggctatgaatttgcggtttggaatatccgcttgctgacggagaacatcgttccagtctttccttgccgggacaaggcgaatgacggcgatctcgccgggaatggactgtgccagtcgtgtgcaggcttcatttcctgcggtgtcgctgtcaaggcagaggaacactttttgggtgtccttgcgctcagaaagaaaacggtcaagggctttgccagaaacgccgcccagggcaagataatttcttgtctgccaatcctgcggataaaggcagataaacgataacaggtcaatcggcgcttcaaagacaaagagctgattgccattaccctcgtgtcggaacggataggatttgtcagacccggcaatgtcctgtctgaatgggtctgccgttcctcgcacatgggcgtatctcggtgtaccgcttcggtctctgccgacaaacacaacattgtgccgctttgcgtcctcgtaaatatccccggaaagaagaaaagcctcaacaagcgtcttgttgagacctcggctttctgtgagatattggattgctctgtcggctgtcctgttgtgcaagggcaagtgaaacgctgtgggcggtgctgtgctggcttcgctctgtccctcaccgctttcgccggttaagagctggacagcttcgggaaaggacttgccgtaaaactccatgacaaaatcaatgggatagccgcccttgctctggctgtggcgaaaccacttgtttccccggacggtcaggctgtcatgttctttccagcggtattcccgtccgcttttgataagcgtctctccctgtgtgcggagaaaatcttccaaactgacggcgtttgcccggtcgatctgtgcttgggtgtactgcatgggcgtcctccttacttcttgaaaacagcgcatcgtctgcaaatgccatgctcacgctcgtccagcgtgtaggggcagttcgcacattcctcgccgtactgtctcatgataacaggcagatagcccagctcctgcaacatatcaatctggcggtcggtgagggtggcttcaaaggcaaggcatttccgggtgtgttcgtccagctcgatcaggtcggaaagcggtctgccatcggtcaaagcttctccgctcaaaaggcgttttgccgttctgcggatggggttgtactcgttcttccagtcgtattttttcatcgtgtcatatcctcctttttgtgtcgtgtttggggtccattttggagcatttgttcctctgtacgctcgttaaatcgggcggcagtatctacacatgacttgaccttccaaagacggtgtaaatcgtctctgacggtcttaaactcgccataggtggtgttgtgcgcctgttccagctcgtcatactcttcggtcagctttttcatatccaccttgccgtccgggaactccccggtcagctttcgtctggcggcgtagaactgtttgagttccgcttcatgctctgccttgtacttggctctgggcttctcaaacttgattttctgcaagccgtcatagacaggcttcaagctctggaaagcagcggagctgtcatagagctgcttaattgctttcattcgggcggtctgttcgtccagcgttttcttcaagctctctgtggcagcactgtgttcgctgacacggctttccaaatcttcaagagagtaaatgccgtttgcccggagataattgaaagtctcgttcatctcctttaggttgctgaccatgcctttctgcgaatacgccccggctctgcgctgggtgtaataggcgttcagcagagaaacaaggtcgggtgcctgcggcttggacagctcggctttcatatccgctatccagccgataagggacgcaattttcttcttgatgtcccggataacggcattggtggctctgatccagcgattgaactcgcctttctcggtgcatatgcctttcttctccattgcccggacggttgcaccctcgtgaacggtgggaagaagctccacgccctgacgctcatagcttcggtggtcaatacgaacatcaagccccttttccgcaaacttgccattgcatagctccgcccatgtctgccgccagtattccagcgtttcgggactgccccagtcggtagtgggaacggcgttgaacacaaactttccgtctgcgtctcggatacggttgccgtcctcgtccagctcatacacccggcgttgctttagtccccatttgccgttctgctcgatggggcggatagggcaaagcacatgaaaatgcgggtttggtatgccgccgtcctcccggtctggctggtgtacggcgaagtcaaccaccatgccccggctcacaaagttctccaataaaaattgccttgcaagagcgatgttttcctcaagggaaaattcattctgcaaggcaatgtcaaagctgtatgcaagctgggcgttctttccacgctcggctttttccacggcgttccatagggtctggcggtctgcgtattcgggcggtgcatgggacggcaggagaatgtcggagcagatcacgccgccctttctggtgtagtcgctgtattcgccgtaatactcgctatacagcttttcgccggaacgataggcggcagaagcgatagcggactgtcctgcgcttcgcttagtctgtgtgacactcagatgaaatagcgccattggctttcaactccttttctctgtttgcttgcttgatgtgggtaatcgccatgtgacggacggctcgctggacttcggacagagaaaagatgtgttccatcagctctgtcatttcggtgcgtgtgagatctttgacctccggggcaaggctctcaatcgtgccgcccagattgcaaaggcggtgggtgcgcttggtgcgttcgcctttctccagaaacttctttctgttctcaagacggttgagcttgtgcttctcctgtgcaagctgcgtctcggctcgttccttttcggttcggagctgttcaagagttttcggttttgtcattgtgattgacctccttttttgatttttgggataaaaaaagaccgtcaacttttcgcacattgcgaccagtcaacggtcagtttttgtatttaattgttatataactgcttactctacaatttcatcagaaactgtaattgtcacagctattcctgcatcacattctatttttctaaaatcctctgttatgtccaaaacttccatccggtttgaagaagttccaattttaacacaaataggaatttctttgttcagctctattggtatctctcggtcgatttttgagtagccaattcccattgattcttcaaacggtgtatctaaagaaggataactgtatttctcatgaccattatcagaaatgttgtatagctcatagctgttttcgatcaatcttatcgctattcttttacctaagaaatcgttgtttccgtgtgtcttaccatcttcaaaccactcaccatcacgatatacccaaaccgaaatctcaaaagatttcacattctcatcgagcgatatatcaaagaattgaatttcatcatcgaacaggtcaagaacttccaatgtttcttctgaaaattcagtaggtttgatagatatcccagattgtttattttgcgaacaggcacatagcgaaaaaatcattgctacggctaacagcacacttattgtttttttcattttctgtcctccgatcaaaactattatttcaaacttgctggcggcgaacagcattttatgctgtttgcagacggcaagtacacaggggatagtcgctttagcggcgcaagggggtgtagccaccttgacggaacgaagtgacgaaacatgctcggtcgagcagttttcttctgctgacagagaatacagctccgcaggacgcactactctcgatagagagtatagaagtgcgccctttagttcctaaagggtttttatcagtgcgacaaactggaattttcaaattagtctttgcaaataaccttcgaaccttcaccatcgattacaattccctgacggttgttaattgggcatagattcaaatccgaaaattcagtcattattttctcagtaactttcttaaatggtgctgtaagataatgcggaagaacatagaaatcaatcaaatcaatccctgcatcatcttcttgtgagtagtcctccggcttttcatccatttgctcgatatattggatgcttggagcgcatataattgcgcctgccgactcgccaatcatcaatttcccatttgccaattcctttttcagcagtccatcagttcccgttttacggagctggtccataagaaagaaagaatttccgccggtaaaatatatcacatctgcttcttcaaaaacagactgtatcgttgaataagcctccgttgaaatatcaatttcagttacgattgctcccaactttttgaataattttcgagccgagccgacataaccggtgtagccttcacgcagtgaagctgttggaataaatgcgactttcttattttcaatttcttcctttatcagacttcctacacttgagaagtgcgaacataaaaatagtttcatcaatattctcctttataaatcacgatttattgctcgcttttcgtattcaaattataccataaacttgtgaacagttctaccgcaactttggactatatgagaaaagtccgaacagttttctgcccggacttcctcgctcaatcgtaaatcaattccgctttcacaatctcctctgcctgtgccttgcaagcgctcatctgccgcacccattccatttggttttcagctttcagttgctctgtcacgccgtactgctttgccagctctggcacgatcagcttcatgcggtttcgtgccgcttcgtcaatctcggcgcaatgctcaaagagcctatcggatagtaccagctcattgaacagtatcgggcggtgcatttccagatacgccttgcgaagtctgccgtagtgtccgaggggcttggtcttgcggataacgatgttcgggataagataatcgccgttctgtgtgtaagtgatattcatgctgtttgtactcctttcatcggctctctctgcggttaaactgctgacgggaacgaacactccctttgcaatgtcctctgcacgaatggcggctttcttggcttcgatttctgccttttttctccccttgattttgtcctcgtatcgcttctgcgctccgctggctttccgcttcaagtagttctgatgaagcctgtccttgcgttcctcacgcttgcggatttcctctaattcctccggggtaagctccgcttctccaaacgccgggggaacgaatcgcccaacaaaattgaagtaaatctcgacctcctgtgtggtctgtatactgcctttacggtcacgctcatgcacaaggattttctcgataaactcgttgagcatggcaatggtcggcttgtcgaagttctcgtacttgtcaatcagagcgataaaacgatcagcgtccttttcgtgcttctcatagctcttgacagccttttccagagtagagatttcagcggtaagctcggactgttccttttcgtattgagcgtccagagtggcgtatctgctgtcggacagctttcctaaaatgttgtcctcatagattttacagagcaggacttccagctcggacactctctgctttgcggtggcaaggcgtatccgctgtttcttaacctctgctgtctgctggctggactgcgcttcctgcaccactcggacaaactcggctcggtcatgctttgcatattcggcaatggctttgagcatttcggaaacaagggacaataccacatcttcattgatacggtgctgtgtcgtgcagagctttccaactgggactttgctgtattgggaacaggtatattgagaaatacgcttgccgttgttggtacggtggacatacatcttgccgccgcaatcggcacaataaagcaagcctgtgaggggagctgcttcgccccagccgtccgggtagcgtctgacattcccacggattttctgcacaaggtcaaaggtctgctggtcaatgataggctcatgggtattctcgaaaattgtccattcgtcctccgggacataatggcttttcttgtccttgaagtgctttcgggtcttgaaattgatggtgtgtcccagatactcacgcttttcaagaatgttgcaaatggtggaagaaccccagccgtacacatctttgaaagtcttgtttttgttcacgccctcgccgtgttgggcaaggtaagcggacggaatgaggactttttcttctttcagcctgctggcgatctgatacggaccgtagccctcaatcgtcatggcaaagatgcgcttgaccacctcggcggcttcggggtcaaccaaccattggtctctggcttcgttccaaagatagccgtaaatgaccgtgcctgtgaggtgcttgccggacttgcctttggactggaaagtggaacggattttacggctggtgtctctggcgtagtattcgttcataatgttgcggaaaggggtaaaatcatcgtcccctctggcactgtccacgccgtcattgatggcgataaggcgaacgccacgctgacgcaggatttccataatctgaccgactttcagatagtcacgacccatgcggctcatgtccttgatgcacaaatactccacattcccggcttcaacctctttcatcattgccagaaatccgggacggtcaaagcaagtgccgctaatgccatcgtccgtgaaatggacaatgttcgtaaacccctgccgtgcggcgaactcctccaacattgctttttggttggaaatggaattgctctcacgctgttggtcatcatctttgccaaagtcatcacggctcaatcgttcatacagagcagtgattttctcgttttttctcataacttgcgctcctttcttcggttttaggttgtgtgttctaagagacttcccaaccgcttgattaagaagtcttttagagcatacaacaccgctggctaatttatactttttatactgccgcacagcaaaatgattcgggttcctcttttccagcccgtcaaacatgtagtcaacggcatttttgaagctctcatcatcttcccggacttccatgctgttaatcatttccacaagggtgttcatgttccgttcttcctccggcccctcaaagacgatataggcaatcaacgcacagtaaagaagggtttccgcttttgtccagaactcgtccccgtccttgccgtcccctttggtgttggcaatcagggcggtcacgaatttcagcacatcactttccgttttgatgtaggccagcgggttgtagtgcatggatttggaaaagtcgatagtgttgaatacccggagccggtagccctgccgttgcaggaaacgcccgcattgttcgagggtgccgctttttggatctacgaccacataggacgaatgggcctgaaggagctgcggggtcagccagaatcttgtttttccagagccggacgaaccgatcacacaggcgtttaagttccgggcgttggccgggattttgggccgggtgttcatcgtcaggaattccgtgcctgtcagaatgacgttgtttttaaataccgggtctgcaaagggcttgatatcctttgccgtaccccagtgggccgagccatattcttcctcacggcggaacttctttcccttcctgattttggactgcacaagcaggtacattcccacggccccggtaaggcccaccagaaggtctagcccaccaaggcccggaaggtaattttcaaaggccgtggggaaggtttttatcatgcctacgagctttgtgccgaaatcggccccggcggccaagcggtaagccgtccctacctttgagaagaaccagaacacaaagaggtaggggaggttgggaagtacatattttcggattttgtcactcaccgttcttccttcaccgcctctctggttttctggcgctcctttggtcgggatttgatatgctctgaaaggttccgtagctggccgaggatagaagccctgtctttccccttattcagcaccttgtcactgtatttctggaacgccgccgtcatggcgtctgcttgccctgttttgaaaaacagaaggtagtggccggggctgaccttatggaacgcatagtctacatgaaattcctttgctatgcggtcaaactgtcggggggctcccacaaggggcatggagttttttgccccgtaatgattcatcagctttttcacgctttggcggccctgcggggtcagcgccttctggtggcgcttttttccttcttctaaaatcttccgtagagcggaagccagcacccggcctgtgagctttgttgcccggattgagagggcaaccgttttttggtttacttcgtcctgcataatacctccttcctgtcaggctcccataaactccgggggccctcttaactttacgggagacagataacctcgggccaatgtggcccgaggtctaccgctcgccatgtttggcgggcggggattcctttcccggttctgcccgtatcttttcattctgcgtccgcatggtgcctaagatggacggctttttttctgccgcctgttccagccgttctatccgggcgagggctttttccacgctgttctgcatggagagcagacaggcgcgttccgcccggtagggggccgcaactgctttgaccagcttgcccgggccttttgtctctgatacggcctccttccccatcagggcccggcctacattttttaaatgcctgcccgcctcgtggtattcggctgaaacggcttcgattttcgcaagggccttttcgtctgtggcaatcccggcctgaatggtttcctttaccccttccagaacttctcgcagatggaagaagcgaggaacaccgtccagggccgccgttcctcgctgtttaaaatcggtaagggcctgtttacagccctctatgatgttttctttcagtacttcaatctgcccccttaactgggaaaccttcgcctccaatgtctgaaccgacctttgcagggcggcttttaacggcgattgcttcatttcttgcaattcctgccacatggcggtaagctcctgaaccgcactggaaagctgttcctccaggtccgacacatggccgatggcggccatgagatcctttgcgctggaaaaattattttccttcaacacggccagcagttccttcacttccttctgctctgccagccgcttttgtctggttttactgataatcaatcactcccttcataaccacgggccagcatggcccgaagcctaccgttcggcctccctcttaggcatgggcggtttttcctgtcccggctcctttggatattcctgcatggttttcaggatagatggtttttcctgcgccttcttttgaagctgggaaggacgttcgccggaaagcggttggatacaagccagacggtcggcggcccagagcgcgttattggtaagttgtcgctgccatgcgcccacgctgggggcccaccggaatccgttccctttgagctccgtccgggtatcggcgtccggtttcccgtcaaaaaagatttgcaggcggttttcctgccggttcatctccacatggccgccctgaaactcccagccggaaaattctgtttcggcccgtttgcttaaatcttcgattcgttcctttatcctgcggatttctgcgctggtgtttgtaaggtcaaagggctttttcagccaactgtaccgggccatatccgactttagcttttctatctggtcgggggagagaagcgcacagccgtcaagtgtcccgtgtttgcggtaataaatgttgacctccttcataatcagttgagagcgttccagaccttccagtttctctttcagcttcgtgatggcctccgggtcatctgcgctgattccgcccataccggtgctgcggattttatcaaggaggccctgaatatgccgccattcctccatgttgctgtcgcgggcccggttctgtttttccttctgtctgatggggaagttggcaggcccggctatcatgacggacggaactcgcgcgtcaatcgcaaactgctggttcatgttttccgccagcttgcgagcataggtatcaagcaggtggtcgattttttcatgaaacatggggtcaacccttgttttctgcttctctgccacagcggcggccttatctatgaggctatggtattcggcggttgcactcccttcctcataatgatagaaactgttcatctctttggcgcggcgggcttctggctcgttgattggatagtagttaatgttacctgcacctcctttgcggcctcgggccatactggcccgaagtcttaccgttcttcatgacctcatttgtcagataggcttcaaacatcatcagcgtttcggccctgttgattgacagtcacaatcccgtccagggtggttgccgtgatgttcaaccgctgggccactgcaatatcattctttacatcttcatctaaagcggtgccacagacaacaagcacccgggcccgccgaagcatatcccggcgcatgtcaatcccatccttgtgttcctcggggatagcgtcattgataaacagcggcagatacaacagcgggcagataggtgagaatcccgcttcgtaagtaatccggcagtattggacagcaagggcggtgtcaatatccggctccccgttccatgccgcagtaatataagctaaaggtcgtttcactgtttttacctccgtttcttctataaaagagtagtagcaggatagagcccaacccctccgccccttcccgtgggaaggagaacggctcaaaggaatttatatccccatcgcttgaccgccttaaagcataaccgggagaaatctgtcaagggtgcgtagcaccgcctacggcggcaggcccttgacagattttcccggctatgctatcccacaaacggcgatggggaattatatatcctttgagcttcggggggtggggctgcgccccatggtcttagtctcgggtcaacatggcccgaagccccgcctatttctccttgtcagcctttttctccggcttgacctgttccttctgctgtcccttccaatcgtccagcagtttgatgatctgatctttcatttccctcggggtggcctccgcgccaaaatattttcccagctctgcacctgttaaaatcactttgtctacctcctttttgtcctccatcatgattccgtcaatcacgtcactattgagcagtttcttttcatcaagctccctcatgcgtttggcctgtgcctgtgtgggggaagcctgctgactgtcaatggagacggctatatagttctggtttttcttattgatataggagagctccacagctgttgtgaagcctatttttttatcgtccaccagcttcatcaggtcgggaaccagctcattgagccgaataaatcgctgaacctgtttaaccgccatcttgttgcgctcggccacaatctcgttggagcgtttcccggcctccttcgggtcaacatggcccgaagtccgggttccctgatgtttgatggcctccaactgcattttcagggcctttgccttttcactggggaggatttcctcacgctgatttaagttgtcctccaccatctgcgtgatggcttcatcatcggtcaggtttcggacgatacagggcatgtccgtgtagcctgccagttcgctggccttctggcggcggtggccggatacaatctcatagccgccgccctccaagggccggacgatagcgggttgtgtcacgcctttgtccttgatgctggaaaccatggcccgcatttcttcatcatcacgcacaccgaaggggtggtttttgaaggcgtggagttcattcagctgtaaatagacaatctgttcctctccccggcggggggactcctttggcggctccgggggtgtgggtgctgcctgtgccggggcgctggctccgggagctcctttggaaaccgaaaccgtacttttgggcttccccggtttagctgtctgtacgggcatttcctttgtttcttttttcggagcggtagtcttttttgtgggttccggcttctcgactttcatctgtccgttctttggcaagtcagatatcttagtaatagtagcggactgttttttgtcgggagcggtagggctgacttcggtttgtttctgctgggcctttttaacttccttcacaatatcgtccagcctcttagaaccagcggcttctgtttccttcaattcatctgattttgtgtcagtctgcttgtccttttcctcactcggttgagctacagccggagccatgtccttgacttcctgactgacaggtgggccggtgggagagggctgttcctgtaaagttttctgcttttcatcagccatgcgtgtagtacctccttttcgtggcatgaaaaaaggcccaaccattacggtcaggcccggttaaggagttatttccttgcgacaattttcgcctccttcctttggtgatagtaaaaaggacagggctggcctgtcctctttaagcaattaaaatcgaatcctacaatgaaagatataaaatatttagaagtcatatttactaaattctattgcatgaaatatgtttcctagagtaagaaaaagttttagacaatcttttttggtgaccctcttttttaacataccgtgaagtaaataatttctattcaaataagctgttttagatttaaaattatctgttttggaaaatagggtatttaaatataattctaaactgtatgctaatagatatttatacacaaatgaatcatctttcaaatcctgtaaaacagtatttgcaaatttattacatgcacctgctcccacattgattttctttccatgagactgttttctctgcaagattagtaaacgccgttcaatcaaggatataagaatcattgagcaaccacggtattctttgtgttcaaaacaagagatggcttctttgatttcacttttatcaatattatatatgtaaagctcatcaaaataggcttgcagttctttatctggtataaaagaaatggcatatttatcagcttctagctgattattaggtataaaatctgtataggaaaagggcgcccactctaaaaaagtccatccgtaattagcccacgtttcaatggacttaattttttgctgtaattcttcttctgatataattgaattgctaattagtgaatctgttaaatgtttaaagcttagagtgatattttcaaaaaccctactaaaatcgtaatgtttccacatatttagtacactatctctgatatcagccattagatccgacatcctgcttaatgcaccggataacacttgtgtgacattttcggtcatatcgagcaagtagttttcataggccgtacaaaaatcttcaaaactcttcgatagcatataatcattagcaaaggtctttagtttttcatcatgtgtaataattaaatctaatgtattgataatatcattatttgaaattgtatttaattccgatacgctaggctttttttccttatcaccgcaaagcaaggcgtgaataaggtatattattttttctcttgcagaaatatcctttataaagatttcggatatttcacagatggcatttaatgagccataatagcatattttataagtttgaccatttaaattgataatagatgttcctgtatcaataattatagaatccactgttcaacgcctcctcaattatgaattaccatcattatatcaaattatctatttatgtcatataataaaagttgcgaggtcgaacaaggcatctaggaatagaaaaaatgatatctctttttcatataaactaaggattaaacagctattatcttttcatcatacttaaaaaccgccaaatctaaggcttttcggcttgtccactcataaatctccctgatgtgctcaaaagttacatcgtggttaggtcggccgcctgcgcggccgcccaacactttcttacccttcaaatcctgccaggagaagttttcctgggcagttcttccgacgaggaagttgccggcccgctgagtgagctgggcgaagtttacggcgtaatcgtcggagccttcctgatacacatagatgctggcttccgaacccatgaaaccgatgtcggcatcgcctgaaatcagtgcggtcataactttgtcggccccggcgccgttaaccagcgtaagatcgatcccttcgtctttaaaatatcccagttcgatggcagcatactggggagcatagaaaatggagtgggccacttcatttaatgtaaccggggtaagggcatcggaggagcccccgctctgacagccggtaagggaggcggccgccatggcggctgtcagaaaaactgaaacaaattttttcataatactctcctgtggattatgtctatatgatttaggatattggaaaaactgtgggttggtgcctgttttccccgtgttttatggaaacaggattgttttaattgaattttcccgttacttcctttataatagcggctggggaagaatagcagaatgccgggagtttaattaatttgcaggaatgcgggagaatgacagacggatggagaattatgaaattatcgttctggatttggacggaacgcttacaaaccgtgataaggtaattacaccgaagactaaaaaggctctgatggagattcaggagcggggaaagaagattgtcctggcctcgggccgtccgaccgacggggtgatgcccctggcgcgggagcttaggctggagaaatatggaagttatattctttcatttaacggaggaatgattacgaactgccggacaggggaagtagtattcagccgtcttctgccggtggaagcgaatgcaaagattatcgggctggcagaggaagagcgggtgaccatactcacctacgacggccacactctcataacaaatgacgctgaaagtccctattccaagctggaaaataagattaacagcatggaggtccgccagattgatgatttgaagtcttatgtgacgtatccggtccccaaatttctgatgatggatgacggtgattatcttgccatggttgagccgagggtaaaagcggctatggggaagaatttcagcatttaccgttcggaaccgtttttccttgagatactgcccagaggcatcgataaggcccagtcactggccaggcttttagagatactgggacttgacaaggagcgtatgattgcctgtggggacggctataatgatttgacgatgatcaaatttgcaggtctcggcgtcgcgatggaaaatgcggtgcttccggtgaggaaagcggccgattatattaccatgtccaataacgacgacggaattgcccatgttgtggagaaattcatgctccactgacgaacaggtaaaaataaatcaataaatatatggactttacgactttagtatgttaaaattgtaaggtactggtggtttacggaaagcaaaaatatataatgaagaggtgcttttacatgaataaaaaactcaagacagaagcggttgaccatttatttcaggcgattctgacccttaagagtacggaagagtgctacagcttttttgaggatgtctgcacagtcaatgagctgctgtctttctcgcaacgctatgaagtggccaagatgctcagagaaaagaggacttatctggaaattgccgataagaccggggcatctacagcaacaatcagccgtgtaaaccgttcactcaattatggaaatgacggttatgatatggtattcaagcggctggaggatcaggctgcggaggacaacgaagcgtaacaattatataaatgtaaaaatgagcgaaaaaggatcacggcttttagggaaaagcagtgatcctttttcgttgaccggatacagggcacgtactgcgtgcgttgaccgtattatacagccgtaccgcgtttgtgccggcgggaacagccttccgtctgaaggagtatgtggatgcgggaaagacggagggaacaggcagctgtattttctaccgagcggcgctgctttctgatttttccgctgagcgcgcatagaagttagccagcaccgcgccggaaatattgtgccagacactgaacacggcgcccggaatcgtggcaagagggtactgggcaaagtgggtggcggccagggaggttgcaaggccggagttctgcatgccgacttcaatggagatagcccggcatttgcttccgtccagcttaagcgctttgccgatcgagaaaccgagcaggtagcccagcacgttatggcagatgaccacagcgacaatcagcaggccgcttgtcagtatctttgatgcgttagccgatacaacggcggcgacgatggcaacaatggctgtggtggaaatcagcggaagaatttctacaatctgccgggtgactgcaaagaaaaagtgattgatgatgaaacctgcggcaatcggcacgatgacaaccttgacgatggacaggaacatacttgccatattgacgtcgactctcgctccggcatagacataggtcagaaccggggtaaggaagggagcgagaacagtggagacagccgtcatgccgacagacagggccacatcgcctttagagagataggtcataacattggaggaagtgccgccggggcaggttcccaccagaattacgccgatggcaagctccggcgggaggttaaaagctttagtcagtccgaaagccagcagcggcatcacggtgaactgggcgatacatcctatgatgacgtctttcggacgggaaaaaaccaccttaaagtcacccggcttcagcgtgaggcccattccaaacatgacaatgccgagcagggtattgacgtaggaagttttgataaagcttacgctctgaggcgcaaacagggccagggcggctactgcgatgacgatgacagccatattctggccgaagaagttactgagttttttcaatgtgttcataataaatcccctttcaaatttgtcggaatgggcagagaagaattaagaaagaattccgcgggcgggattctccgcctgcaacaaaaaaacctctgtctccattaagagacaaaggttataatcctctgcggtaccactcttgttgccgttaaacggccactcgtccacatctgtcaatgtgtaacaggataacggctgttaaccgttcagtcttactggtaaagctgttcagtctgaaagctcagaggtgattttcttccggtgttcctgctgactcgcacctgccgtcagctctctgaaaggatacgggacggaatacttttcctcgtcaaagcttgttgttgctggctatttaattaagagtgattctaccgcgttaaagcagatatgtcaatagccggatttgccttttaaaaaaatccgtttgattgatgacggtgacctgtgcgcggagcgtgcagtttatcgttttatttgtcctcccttcaaaaagagggggcttaccggagttactttttcttcttcggcggattctcctgcctcagctgttcggccagtagttctatcatctgttttttcagatacacgtcgaatgccagctcacagatgaaggaaaagagtctaaggtattcctgatcgtcaccctcagcgtcctggaaggttccggaagctgccttaaatttcgccattacatcgtctttcagtcttttgcgctgctcacgctccagtgaaaaaatctccgtgtacagctctgccagttcaggattagaaccgtccgcaaaatgattttcgctgatgggagaaaaaagctgctcaatatcgttgaaagatagtacatttttaaaataatagataaaaatcaacagcaatatatggtttttagaatatttctttttctccggcggcggaagcaggttattctttgcatagttattaatcatggttttcgtcagaatcttatcttcaccaaaccgcttggaagcagataaatgtgtatccatgaaagtggtaacctgatccatatataaatcaatggcggggatatcagacggattgattctggtcacactgtccagataagccatcagatcctgcagtcgttcttcattcgttttcataaaattcacctcaaatcttattatatagtaatgaatactagatgacaagacctaaaagctgtttattttataatgttgtcagagtttttattgtccgcactgcggcgtttgctactgtccgcatgccacttccctgatgctgtatcgaggaagcaatacagggaattcacctgctcttttggaaaacagagttgacaaagaatgtatgttcgtttagaatgttagtgtgcttacatttttggacaaagccaggagcggaaaagctgattcagattaatttaagaggcaggcgtccgctcccgaagccagcttgatatttttaaatatagggaaaaagcattcaggaaggaaataaagatgacagttaacacccatgtcggatttgaaatccgtgtattatctaatcttatttaccgcagaatcaatcagatgtcggcccaggaaggggagacgctgaccgcgaaccaggactgggttctgcattttttgattcagtcgcaggggagagatatcatgcagagggacattgaaaaggaattttcaatccgccgttctacggccagccggactctgcagctgatggagcgcaacggatatatccgccgggagccggtttcctatgacgccaggatgaagaagctggtagtgacggaaaagggagccgaggcacgggagaggatgatagaccgcctgaaccggtttgaggcagagcttcagtctggaatttcccgggatgagcttaatcagcttacgcgcacgataagaaagctggaagaaaatatcaagtagaccatgatatggcgcatattttaacacaatatgaaatagttattgcaggcaatgaaaaaggagaattatttacatgaacacaaacagagaattatttgaggaggcgccggtccccaaagcggtggccctcatggctgtccccaccatgatttccatgctggttgtggttatttataacatggccgacacattttttatcggccagaccggagatccccttcaggtggcggccgtttcgctggctacaccgatctttatgatttacatggcgctgggcaacctgttcgggatcggcggaagctccgccatatcgcgtgcgctgggagagaagcggatggaccgtgccagaaacctgtcgtccttttgctgctacggctctatcggcctgggcataatagttgcggcgctctttatagccggaatggatttgattctgaagctgataggagccagcgcgaatacaattgagtatgccagacagtatctgacctacatatccttcggaggcccctttatcatctttgccactgccttcggcaacattctccggggcgagggggcagcccgggagtcaatgataggaaatctgattggaaccgtggtcaatatcgtactggatcccgttatgattctggggctgggctggggggtaaccggcgcggcgatcgctaccgtcatcggaaatattgcggccagcgccttttatcttgtctattttctcaggaaaaaatcatccctctccattaagcttaaggactttaagatgggggaacggatcgcatccggtgttgcttcgattgggattccggcatccctgaataatattttgatgagctttgccaatattattttaaatctggcattggttggatacggtgacactccggtagccgccatgggcgtggcgatgaaatcgaatatgctggtggtgcttctgcagattggcctctgcgcaggcatccagccgctgattggttataattacggagccaggaataaaaaacggctgatgcaggtcttccgatttaccggtatctgcgccgtgatcatgggtacggtgctgacgattatcatgatgattgcacgccggacgctgattcaggtatttataaacgataccgaggttattgcctatggaatccagatggtcattgcccttcagctttccggcccgtttatcggcattctgtttctctgcattaacacaattcagggaatgggaaaggcgctcccgtcattggtacttacggtctgtcgccagggcctgatttttatccctcttgtatttattctggatcggatgttcggactggacggcgtaatttatgcgcagcctgcggccgattatttgtcaattgtattgggcattatcatttgtttctggctgtttaaggcaatggcgcaccgaaacggcgcagaggaggaattctgatatgggagaatctgtggtggaacaggtaaaagaaaatatatacaggctgggcgtaacgctgccccagaatcctttaagggaactgaacagctatctgatccggggcggggagcgggatcttctgattgatacgggattccgccgtccggagtgccgggaggcgctgatggcaggtataacggaagccggcagcagtacaagccggatcgatgtgcttctcacgcacctccactccgatcacacagggcttgccagggaggcggcggccccggacggccggatttatatcagtgagacggattttaaggtattacaggagggttttcttccgcagcgaagcctgctccgtcaccgccagtttttggaggccggttttcctgaggaactgttaaatgtaacagaggcggttaatccggcgtcccgctataagctggatgcgctggacggacgcttttgcccgctgcgtgaaggtgataagatccaggccggcccatacagtcttacgatgatttccgtgccgggacatacgcccggcaatgcaatgttctgggaagagaagcaccggtttatgtttacaggagatcatatcctgtttgacatttctcccaatattacatcatggctgggcgtggaggactctctgggcgattatctggacagcttgaaaaaagcaaagaagtaccctgtggtttttgcactccccgggcacagaaagacgggaaattatgaggagaggattgaacagcttctgcttcatcatgaaaaacggctggaggaggtcataaaacttctcgaggaaaaaccggatatgacactttatgagctgactggaaagatgcggtggaagatccgggcggccagttgggaggatttcccggcggcccagaagtggtttgcggtaggggaatgcatggctcatgcggatcatctgcagaagcttgggaaggtcagccgttattttgaggacggtgtctggaggtaccgggcggaggtatgatatatcaaggatatctactcagtgtatgaataaatgcacaggctttttgtctaagagtttttcgtgacatacacaggaaaatatattataataaatttcacgttaccctgaatatggaatcagataaaaggcggtagaaaatatgaacaaatacgaattactcaatccgatgcagcaggaagcggtatatcatacggaaggtccgcttctcgtactggcgggagcaggatcgggcaagacccgggttctgacccacaggattgcgtacctgatagaagaaaaacaggtgaacccatggaatatcatggctatcacttttactaataaggcagcggctgagatgagggagagggtagacaagattgtcggcttcggcgccgagagcatctgggtcagcacgttccattcctcctgcgtccggatcctgcgcaggcatattgagtacctgggatacagcactaattttacgatttatgacggggatgaccagagaaccctgatgaagcagatattcaagcgcctggatgttgacacaaagcagtttaaagagcgggcggttctcagcagaatctcttccgcgaaggacgatatgatcacgccggaggaatttgaactgaacgccggaggcgatttccgggagaagaaggttgcccagatttataaggaataccagaaggagttaaagaagaataacgcccttgattttgacgacctgattgtaaaaacggtggagttgttccagaatgttccggatgtgctgaattattatcaggagcgtttccgttacataatggtggacgagtaccaggataccaatatggtgcagttcaagctcgtcgatttgctggccggaaaataccggaatatctgcgtggtaggtgatgatgatcagtccatttacaaattcagaggcgccaatatcgagaatatcctgagctttgagaaggcatttccgggggctaaggtaattaagctggagcagaactaccgttccacccagaatatcctgaacgcagccaacggagtgatacgcaataaccggggcaggaaggataagacgctttggacagccaacgacgaggggaatctggtccggttcctgcagtttgatacggcctatgaggaggctgaggcgattgtaaaagacatacgacgggaaaaggaagagacaggcagggaatattccgactttgccgtgctttacaggacaaacgcccagtcccgtctgctggaggagaaatgtatcctgtacagtattccctatcgtctggtgggcggcgtgaacttctatcagagaaaagaaatcaaagatattctctgctatttgaagacgattgccaacgggcaggatgatctggcggtacagcgtatcatcaatgttccgaagagggggatcggagccacctctgtcggcaaggtgacgatatttgcgtctgccaatgggatgagcttttatgacgcccttctgcgcgtaaggggaataccgacccttggcaaggcggctgacaagatcggtgtttttacagagcagattgaagattttaaagcacgccttccaaagatgagcatcaaggagctgatcgaagaagtgctggagaataccggatacaagaaggaaatcgaggcggagggcgagattgagtcggaaacacgtcttcaaaatatcgaggagctgattaacaaagcggtcagctacagtgaaaatgaggaaaatccgactctggacggttttctggaggaagttgccctggtggccgacgtggacaatatggatgaatcggagaaccgtatcgtgttgatgacccttcacagcgcaaagggacttgaatttccctatgtatatttaagcggtctggaggacggcctgttccccagcagcatgtcgattatgtcggacgacaaggatgcggttgaggaggagcgcaggctctgctatgtgggaattactagggccagggaaaaactgactttgaccatggcaagacagcgtatgacgaacggggaaacgaggtattccagggccagccgcttcgtggaagagataccggcatggcttctggagcaggaagaacagccgtctgtatttagcagggccgctggcaggtcatggggaggcagcccatccgcttcctcttcggacagaggctttggagaagcggcttcgtccggctggggcggagccggctccggcgtccagggttcatccgccaatcgttcatggggacgttccggcggcattacgaccggatggggagctgcgtctggaggcggcgcaaccgcctccggctttggaagtacggcagggaaccggcagggagagggagtcagcacatttggcgtgaaacccaatgcgtatgcctcaaagacagcgccggctgccccctccttcggcaaagcattttccgtacaaaaagcggatcatctgccatactctgagggcgaacgggtaaaacatgttaaatttggcgagggtacggttaaaaagatagaagatggcggcaaagattttgaggtcacagtggagtttgaccgggtaggcgttaaaaaaatgtttgcatcatttgccaaattattgaaggtttagaaaaggatgcgcactgcggcggaaggattggcggcgcttacgtgaaatttttcttatttgatcgccatattgtgtaaaatttgaaaaaggacaaaaataggatagtaaaaacatgatattggtgatataatataaaggaaaaaacatcggtgcaggatcacggaagaaaggatgtggaacctatgaataaatttgatatgatgggtaaggatgcattgtcaaaagtagaagaaatcatgaatgcaacaaagctgaatgaatttttacacagaaaagaagaggaagagaagaaaaaaacatgtattctttggattctcgctattatcggtgttgtagcggcagtcgcagcgattgcgtatggtgtatacagattcttcacaccggattatctggaagatttcgaagacgattttgaagatgacttcgatgacgacttcttcgaggatgatgcagaagacgacaaagaataaaacgctgtgtgatgcgataaaatgtatctttttaagtacaataagataagaggatgagagaggcgccggaacaggcggccgtatgatacggtcgttccggcgccttattgattgattgattgagggcggtgacctgtgcgcagagcgagcagattctgcgcgtctgtccgcagctatttgatgtcatttgttacagtcctgtcagttcggaaagctgctccagaattccttttccgccgctcacggaaatattgcccactttatcgcagattttctctaaatattccatttctttgagcttcaataaagttttattttcatccatcagctttgccgtatttaacaggctcctagtggatgccacctcctcacggcgcatgattacgttagcctgggcctttttttcagcgaccagtacggtattcatgatgtcacggatttcgccgggcaggatgatatctttgattccggcatttaagatttccacgcagtagtcatcctgctccgcttttaactgctcacagacggagcggccgatctcatctttctggacaagcagttcatcgaggcggaagcggcccacatatttcctgatacataattgggcggcagtatagagctgcgcggaagctccctcgattgtcctgaccagcttttccgggtcagtgatccggaaactgcataccacatttaaccggacgcttaccttatcggcggtcaggatatcctggccggagatatctaactgctgtgccttcatattgaaaattttgcaggtaacctctttgccgtagttccagaaataccagttgccctgctccagccttttttcaaacttgccgtcaaaatagagcaggccgatctcaccgtctttgatggtgatttttttatagaatttgaccgggatcagatctatgtaatatcttggcagggtctgatccatatacggattcgtgatatctaccaggcggatctccacatcttcaaacacgttccagtataaagcctcgggacctgtcaggacctccttgaatgctttgttgacaaagcggatagccagacattcgtccgggatatttacacggattacacgctcggaaaattctttgtttttcatcagaacctcaaccggaatcccgcaggtgttgacggctccggtcatcgggacaattttcagctcatagcccatagcttttatgtaatggcaggagccggcggcgagaaagctttgaaatcttccgttttttaacaaataaccgcattcttgttctttgattatatatttcataaatgtttacctccatttaaatttggttctctgtgatttttttgaaaagcagttttagagcagttacgtcccttcttcaccaaaagtctgcggacctttttttcagtaccggttttgccctgcggctgagaggcgctgtatcagccgcctgctctggcacagagtctgccggaacggtatccaaatcggttctggcagttttttggctgcttcttaatgcgcaatctttggggaaggcggcacggccgttcggcggtgcgtaccctgaccacgcagattcgcagaaggaaacggaagaaggggcgtctttaactctgtgatggtttggccaacatcttatcaggatgttccaaagtttaatgattgctataccacttagctacatgctttcgcaaggaaggattcgaaccttcgacacatcatgttatgctgactggccggaatacctgccgatcagggacggaggcaccgcgggggctctcctggagataacccctcgcctgtgagacagcctgcaatgttttgagagttatgtttctcatgaatttatcataaaggattgtgggagaaatatcatttaaaaaaagttgcgaacttgttactgtttgcagaaccgcgttttttacggggctgagaatagtaatgcggacttcctgaagagggtaagaaccatattaactgggatacgggcagagggaggctaaatgatagaatcggtttgacaaggcgaaagccagacggtagactggtcttaaagaagaaaaaatcggtttgagccgggagtgatggacttgagccgggtgaagagataagccttgatgaatgtgatattacataattaagataaatataaggatgtgggaagatggcggaatttcaggagctgattaagaattttgaccgtattcgcgactatatgcggcagttttatgtctacgggttcaaggtgaggggcgattatgatgttaaaagcgccaggacctatgataacgagaagcgcaggattgagagctggctttctgagtatatggtgtcggaatatacttcaaagggaaaacaggtttatatcaacgtggacagcaggacaatcaggcagaaccctctctatgcggcatggaaggcaaagagttttaccggcaatgatatcatgcttcatttttttatcccggctcagctttatgagaagcgggagggactgagtgcaggggaattgggggatcggatagcggaatgctacggtgtggttttcgacagccagacggtgcggctgaagctgaaggaatatgaagagatgggaatcctgggtacggtaaaaaagggaaaaacgctgttgtatcatttgaagccgggtttgcaggaagacagcttcctgcctcttttaacggcagtaaagttttatcaggaaggggcgccctttggttttatcggcagcacgattctggaccgtgagaattctgaaaatgacagattccagtttaagcatcattttattgtacataccctggaggacggaatcttatttgagattctggaagcgatgagggaacaccggtggattgagtttgtcaataaaagcagccgcagcggcaacgagtcttccatgaaggggctgccccttaagatattcgtcagtaccaggaccggacgccgttacatatgctgctatctggagaaccggcgccgttttatgaattttcgtctggactgtatcagtaaggttaagatgacatcagtatgtgaggattatgctcaatggaaggcagcgcttcaaaaaaatctggggttgtgctggggcgtatcttttgggggcaccggacggggggaagagatatcggtgaaattctatatcgatgaggagaaggagtcctatatcctgaagaggctttaccgggagggacgcggggctttggtcagaaagacgggagaacacgaatatctctacaccggaacattttttgataccaacgagatgctttcctggctgaaaacgtttaccggacggattctagatattcagtgtagaaaccgtgcggtggttgcgaaggtaaaacgggatctggaacgaatgtatgagatgtactgcggagatgaaaaagatggagttatttgaaaagatatatagctgctattaccaggtggttgggcagattttgagggagtcagagaggcatccggttacagtaaaagagatggaaggcatcatccggaaatatggttttcaagaaagcgtccttacgattcttccaaatctgaccggcggggaatgggctttcatgaaaaaaggtagggacggcacgtatactccggctgtttcgcatctgccgaagctgccgcttaccggactgcagcagagatggctgaaatccataattgcggacagaaggataagcctgtttctaagcgacagcgatctggcgtgggccggggagctgctgaaggatacggagccgctgttcgacgaggaagatttttattattttgacagatttaaggatggggatgactataactctaaacaataccgggaaaatttcagaagcattcttcaggcgcttgaaaagaaacaggcgttatttgtcgcctatgaaggaaaaacggatgatacggttacgtatgagacgctgccctatcagcttcagtattcttcaaaagacgacaagttccggctttgcagcttggaatacagccgggggaatttcagacgggaattgacactgaacctgtctaaaatcagggcatgccatccttcaaagcgcgaggtttccatagaaccggcagagtacagattttgcaacagaggaaaatcacaggagccggtagttctggaaatcagcggggagcgcaattcaatggaacggtgcatgctgcaatttgccaactatgaaaaacatacggaatttgacgaggagagaaaatgctggatttgttccatttattatgataaggccgatgagacggaactgttaatcgatatcctgtccttcggtccggtggtgcgggtgctggggccggagccgtttctgggacttattaaggccagagtcaggaggcagcacaggttatttcagcaggtatgagcagactactgttcacacggttgtgtcccgcgaggtattttcatgcgcattctgcacgaaaatacctcgcggaacacggcgggaaacagcggtttttgccgtttctatgcatcgcggagcatgttacagcttgcaggaccatctttttgcggggctgtgaactgtaacatgggcaggggacgggaatgagccggattttgcttttcatcagctgttttttcgtgtatactggtaaagccagtagaaagaagaaagaaaacggagcaggccgcggaaacagggtacggattacggcggcggataaaaagatgcgcatcagcaaaagtgctgtggtttcaaggtctgacgaatttataagaaagtataagaaaactgataaaaggagtttatattaatatgaaaaaaggtgagatttatgaaggaattgttgaaaagattgaatttccgaataaaggaattcttcatatagaggatgagaaggtcattgtgaaaaatgctcttccggggcagaaaatccaatttcttgtgaacaaaaagagaaaaggcaagtgcgagggacgcctgatgcaggtcctggagcggtccgaaatcgagacagcggagacagtatgtcctcattttgggatatgcggaggctgtctctatcagacgattccctatgaaacacagctggaaataaaaaaagagcaggtgaaagagctgcttgacggtgtctgcgaagagtatgaatttgaaggaatcaagggaagccctctggcggactgctaccgcaataagatggaattttcttttggcgatgaggtgaaagacggccctctggctcttggcatgcataaacggggcagcttttatgatgttgtgactaccggcgaatgcaggatcgttcacaaggatttctgtgatatcctgctttgtacgaaagcgtatttcgaggaaaaagaagttggcttttataagaagatgcagcataccggatacctccgccaccttctggtgagacgggctgtcaagaccggggagatactactggatttgattacgacaacacagattggagtggaagaggagaaggaactcctggccggatggctggagcgccttctggcactgccgttagaagggaaaatggctgggattctccatacaaagaatgactccctggcagatgcggtgaaggatgaggggacagaggttctttacggaaaggattatttctttgaagagctgctggggcttaaattcagaatctctccattctcatttttccagacgaattccctgggggctgaagtattatatgaaaagacgagggaatatgtgggagagacaaagggaaaggtggtatttgacctttacagcggaacgggtacaattgcccagattctcgccccggttgcagaaaaggtagtgggagtggagattgttaaagaggccgtggaggcagcgaaagagaacgccaggctgaacgggcttgacaactgcgaatttattgccggcgatgtgctgaaggttgtggatgaactgacagataagccggaactgattgtgctcgatccgcccagggacgggattcatccgaaggcgattgagaagattatcggctttggcgtggagcggatggtgtatgtgtcgtgtaagccgaccagcttggcgagggatctggtgattttgcaggagaatgggtatcgggtggagaaggggtgttgtgtggatatgtttccggggacggcgaatgtcgaggtggtaataatgatgcggaattgtggtttggaaggaaaatagggggggacgcaagatatagtgatttgaaggaccaaaatggggtcaaaaacatggtaaaaaccgtttttgactccttatttttgccctttcgacagatgacatcggagatttagagataaaaagagaaaatacgaggaaagttcttcttctggatagtggggtatatatatcccgataaccccagggaatttgacttttggtatatggtggtcaaaacaggaatggataactattctttcaaataaattatatatgtctttttgactatctttttatatcttcttaaatgtccgcaaagccttattttatcggctctacgggcatttttcttttatggtaaacctcacatatctaggtctatcttcttatattttcgctatcaagcgtggttaaaatcgtggtaaatacttcttatgcgattagacgctgaacctctgattttgcagtatctatggacgcatgagcgtaccagttcattgtgatactgatatttgaatgtcccatgatatactgtaaatctttcgggttcatgttcttgcttgccagtcttgtacagaacgtatggcgtagtgtatgcggtgtgatatgtggcaaggggttatccttatggtgcttgttgtatttctttaccatacggacaaaaagcatattgtaatcaatcgcaactttaggcttgcctttatgattgacaaatagaaagttgccccgtccgtctatcacaaatggttctgcctttgggcgtttcttcataacccgttgaaatgcctgtatcgtttctctgcttaatggtacttgccttattccgctttttgtcttaggcgtttcaatataatagccctgttccttgctctttaataactggtggtcgataaccactacttcatggataaaatcaacgtccatgattgtcagtccgcacagttccgagatacgaagtcctgtctttaacagtatcagcacatcatcataatacttatgatacacgttgtccgtcttgatgaatgataataaggcttgttcctgttcctctgtcaatgctactttctctttggtatcattttctaggacttcacttaacttgaaatcaaagggatttttccttacataatcatcttgaatggctatgtagaatgacgcttttaacgagcgtttatggttgttaatggtattgtaggaaaagcctttgtctttcatgcgtaacgcccattctttagcgtcagagggtttgattgtatcaatgctcctagcacccagcttgtcctctttcaataaccgcatgagctgttcccgttgtttctgtgtgcttttcttcacgtttgccctctgtgcgttctgtttggcgtagagttggcaaagcgtcattttcttgcctgtgctgtcgataccgtcctcaatatcccgtcttatctgctgttccagttctcgaagtgaggatttttcccgttttccctttggtgtcgggtctgtgggtgtcaatctccaagcatacacatattttgtgtttccaaatgcgtccacatatttatataagtattttccgtctgttcgttggctctctccagtatgcaggatacgtcctttgctatcccgtcttttttctttcatggtgtctgctcctttccttgttggaaagagccttgatatgacttgtgttcatcataacacatacaaggctcatttgcattagattgcgtccaatttatcaatgaccttttcaaactgttggcgtttaatctgtatgcggttgccattcataatgagccagccagcgtccttgttttcctctgccaatcgtcttaacttgttttctccgatacggaaatactttgacgcttcttcaatggtaagggtgtatttttcccatacaggaatatcgttgttattcatcagataccccctttcccatgtttcgtgtcatactggatataggggataaggtcggtgcggtctatcctctgtaagtgggcggttagtttactggaaagggaattgctgtatcttgctttatcaagcatagttcccactttttccaatccacctaatgcgtcatgttcttctaaaaagtaaaaacttttgacagcggaaatcacgccaccctctgtgagccattgctgtgtttcttcaagagaattatgtagtttcggtacttgtagttttaagactttcacagcccctaaaaagcgttcccaaaaccgacacgttttccatctgctcttattactttcatttctgtttggcacgacaaagcgtaggttgcttgccagcagtccgaaagccagttccccaagttccagcggtctgtctttgaatgtcatggcaaaagcatgagccttatcatcacgtagttgcatttctgtccgtttccaactgccgacttcatcaagtgtcttattatgttttgaacagacttccttatctttatcataaaagcggtaggacaatcctgatttaccagcaccgatataaacggtctttgcggtgtcgaaatcatcaaacttgctttcgtcaaagtggtagccctcactattcgagataaattcctcttttttgcatttcttctttatctgctctatggtaaagaatggcttttcgttcttatcatcaatggcaatatccagtcttgtgaaatggaaattatccagtccgtatcttcgctcacagcgtcggaacatatccccaaaagtataattcctactgtcgagaatacggaaaatatcatcacaacctctgccagtcataacaagataacagcctagcccctgtgggttgtcctctgtctttcttgcgtcccccgatacataaatatctccaatctgccagcgtgcttgatacgtcttgaatttaacgcttgccggatagacattaaaaatatcagttggtaaacctaaaatgtgcatgattacatcttcagcggttacagtatcaaatacaatgctgatgtaatcaatcttaacggataaatttttgtgtgtagttatagtacatttctcctttcgtatgccccgtttttttgcggggtaaaaattgtgttttttcctttatttatcacagtttctaggtactatgacatgtatacgcagggcggtgttacatatacgccctgtacgaacgccgaaaggcgttccctttcttcctgtgtctgctccgttcttaacgctcacgagcctttgggaggctcgtggctaaacggaacagccccagtcagaaaccttattttctgtctgatagtccatggatattcatgctatcaaagtgaaaatatctgttctatatgcttactcaagcgtgcgattgaccctggcgtgcttaatcactctatctgatacgataataatgccataaggattatttgtcaataagtttttgttgactttttaatatttattaagtatgatatgcttataaagacaagataagaagtgaaaggagcggttataatcagttatggaatatatcaagaaaatccgttttttaggagaaaacattcagaccataaggaaacacagaggaatgaaacagcaggaactggcggacaaaatcggtatcaatatgcagagcctttccaagattgaaagaggactaaattatccttcttttgatacgctggaaaagattatggatgtactgggtgtcacgccgaatgaattgttgtcgggagaatggaagtatatcgaccacaccgagccatacatcatggatattatcaagagggaacaggattttaatgtttccctggactatctgtctgaaaatgaatttttcgacaatgaacaggagtgcagattttacaaggttaccaaactcatgcagtatatccataactacattaccaatgaggttgtggagttggaagaacttatggaaatcaagcagttgatacagcgtcagaaactggagcgtatgatgagagtgcataaggaaatgcgagggttagaccgatacagagaacagcccaaagagtataaataccatgacccttatgatgactggatattccgtcaacttgcggacatggataacagaaacaacatacccgacacttcgccacagttagattttgataatatggactgtgaagattatctgaaagacaggtggaacagaggactttgattttcctccttcatggaagataccgcaaacaaaaagccccgtaaagagtgcaaagcaccacctgtggtggcaaggctcttgacagggctttttctttcctgtgctgaataatcaagaggaagaaaggtaagatgtgccttttgtagaaaatggctgaaacagtagaataatattgcgatatttaggtgtgacaaaaatgtaaataaatattgacatcttagttatagtggattattatttagttagataacactaactaaaggaggaatctaattatgaaaagctcaaaaatagcatcaaaaacaataggcattagcttatcacttctgcttgttttacaagctcccatgacagcttttgcttcagaactatcagacacaaacaattctgccgagacggccattcaaattgataaagtggatgataatacttttctggtaaatgaagcagatagtaaaaattgggtcacagtcaatgaagctgatggcatcagaacaatcaatattttaaattctgaaacaggaatgactgactacatacaatatgatcaaaacgccaatactgtatactcctcttttacgggcgagacaatagatttgagcgaacatcctgaactatctccagaagcttcgttttattcagatagatcagaaagcagttatgtatatttcgtatgcacaaatcaaatccattgttggtggtgctgctagtgttgcaggtgtaattggagcaattctattttttgtgccaggggcgcaaggcattggaggaggagcaagtgcaattagtacaattgtaggaacaatcaatagccaagttgatgcaagcagtaatcacgggataagactaaaaataaaagtcaccaagtattacagaacgcgcatggggcgcagacaagtatataaaaccacgcgtactattgaatctgcgtcattgtattagatatgaaaagaagaaaaatagatacatggattttctttatttgcatgctgattctcatattccaaaataatattttgccagactctcatgttatttttacatggtgtatcgtttgtctggcatatataggaattatcagtgttttaacttttaacaagcagataaaaaagaaaagtaaggtagttttgattagcttatttttaatttctttagcattaaatttatattttctactataaagacaccatttaggtgtcttttatcgtcatttccattgtcatatcaaagctcattcaatcgtggtaaaatcgtggtaaaactattgtttgtctatacttcaaaacgttcgaaagtgtagtgtttatgcagataatcgaaaattagatacaaaattttaattaaaaaattaaatgctacttgtgtaagactaaaactctactatgtgctggaaaagtggtatttacttcttcattattagaggactttttcagggacatttttcttacttttttacagatggtaaaggatgatgtttcatggtaaaatattatactagggtgtaaagacatcgatgaataaaaggtcttattatgtgctttatttggttgggggagggactgcttaatatggctaacagaattttcgataaaaagaatgtaattttactgaaggttaacgaagatgatttgaatacttttttagttgatatggatattgacgatgaaggaaatccaaaatattgtttggacgattttactaaagctatatgcaacacaattccagaatatgtttttgcgcaatatgaagatcccaatattcatcaaaatgatattgttgaaaagttaagagaagcggctcattgcatttataaaatcaaagactttcaattaatgaaacagtggtgtgtagataaagatattaatgcatataacgaattaaaaaagtctagtacagctaaacggggagaatttggagagttgttgttgcatttgatattaagggaatttaaacgtacaataccacttatttctaaagtttattttaaagatagtgcgagtgtgcctgcgcatggatttgatgcagtacatatttccacggatgaaaaaattttatggcttggtgaaagtaaactttacgatgatagtaaagagggaataaaagcattagtaaaggatttgaatgaacatattaatatagaatatttaaatgaccagtttgtaataattaaaaaaaatcttgataataattcaatacctgacagagaacaatggattgatacgataacgaattgtacaaagctaagtgataaacttaatattataaatataccaatgctttgtacctacacacatgacatttacaaaaagttttctgatatgaatgatcctaatgcagtagcttaccataaattaaatattagagagttaaaagaatattttgataaacagaacaaaatgccattaaaagatagagttaatattatacttatgctatttcctgtaaatgacaaaaatgaattagtcattaatttgcataaacgtctttggcatatgcagagtatttgaggtgaaatatggacaagacaacagagattatattagaagttgaaaatgtagaaataatttcttgtgaacagagttttaaaatcgtttcatattgcacacaattgttgtcacaacattcagcggaagcagaattatccgcaagaaagatagtaatacatgttctgaataattggggaaaagttgatgacaacttatatgaagtgtgggcggatttgattgaaacattaggattttatccatatattcaaaaaaatagcactgatttaaaaattatgtcttttgctgatgatgtgcgaatgagttattttcagtcagattttttagaaaatacatatctacataaagaacaaaagaaaatttctaattatcttctggcagggaaaaatataattgctagtgcaccaacaagttttggaaaaagtttgctgatagaagaaatcgtagcttcaaaaaaatacaaaaatatagttattatacagccaactttagcattgctagatgaaactcgattaaaattgaagaaatatgccgatgactacaaaattatagtgagaacttcgcagccatattctgaagataaaagaaatctttttctgctaacagcggaaagggtaatggagtatgagcccctacctcaaatagattttcttattatagatgaattctataaattgagccttagaagaaaggatggccgggcagataccttaaacaatgcgtttttgaaggtggtaaataaattccatcctagattttacttcttaggaccaaatatagatggaataacagatggatttgcagaaaaatatgatgcaatattttataagtcagatttttctttagtagattgtaatgtaatagataagagtaatttaattaactggagtagcagtgataaacagattgataaagaaaaaatctcaattttgtgtgaactattgagcgagttacgaaatgaacaaacgcttatatattgttcaactcctgcacgagcaagacgtatggccaaagtatatttagaatatttgcaaagaataggacgagaaaacaataatcaactaccattaatagaatggattgataaaaatgtttcgccggaatggagtttggctaaggaattgcaatacggtgtggcaattcatgatggttctctacaaaagcatataggagcttcaattattaaatattttaatgagggacggttaaattgtattttttgtacctctacgataattgaaggtgtcaataccagtgctaaaaatgtaattttgttcgatgaaaaaaaaggaggaaacgaaatagatttttttgattacagtaatattaaggggcgttctggaaggatgatggaacattatgtgggaagagtatttaatttttgtcacgttccaatgcaggagtctattgtaatagatatcccattttatgaacaagatccagaaatattgacaaatgagatacttattaacataaaaaaggacgatgtaaagcaagaggtcagaaagcgttatgatcagattaatgcacttcctgctgatttattaaatattattaagcaaaatggtgtttcagtaaatgggcaaatcaggatttataataaattaattggtgatatgaaatcaaagggtacattacaaaatatccaatggagtcaattacctacatgggatcaaatgtactatgttttagaattggcagaaaataacctttttaactttgatagcaaaaggggagtattttcagtaaaacaacttgcaagatatttgaatatgtataggacgaaaaagaatattattgatattgtcaatgatatttttaatagtaaaattgagactgtaaagacgctgacagatgagagaaaagcaaaatattatgatgaagctatagaaacagcatttcatatctaccgacattggtttcagtttactatacctaaggcgtttagagttgtagatagtattcaacgcctgttatgtgaaaagaagaacgttaaaccagggtcttataccttttttgtacaacaattggaaaatgattttatacgtgagaatttatccattctagtcgaatttgggataccaagtaacgctgtaagaagattggaaaaggttattccggctagtctgttagaggatgaagtcattgattttattaagaaaaatcgtagtaatatgaaaaagtatttgttactatatgaaaatgagcggttagatcaatgtatatagaagtagtaggagaatgcatattgttccttaaaataatagcttggatgaaagaagataatgtatgtgaatactgtaatggcatttccgtcagttaatatttaacatatgtagcttttacgggtagtaacccagatgattttaagatgcgttatgaggatgaaaatatatggctaactcagaaaatgattacaattttatatgatgtttttattttggtaattcatcagtatcttaaaagaatatttgagataatgaactgatggatgaatcagttattaagaaatacttaataactgcctcgaatggtaaatcctacagtacgaaacattataacttacaggcaatcattgccgttggctttaaagttaataacgaccgtgccgtaagattccgcaaatgggctggacagattgtaaaggattatacaattcaaggttggacgatggacaaagaacgcctgaaaaaagggcatatgttcaccgatgaatattttgaacggcagttggagaatattcgagagatacgtctgtccgaacgcaagttttatcaaaaggttacggatctttatgctacagcgtttgattatgacaaagatgccaagactacacggcagtttttcaaaatggtgcagaataagtattccgatatcggaatatgaacaagatgcactgggccgtacatcggcatacggcagcggaattgattgtagagcgtgcaaatgccgaaaaagaacatatgggcctgacaacgtgggaatcagcgccggatgggaaaattgttaaggcagatgttactgtggcgaaaaactatctgagcgaacaggaaatgtcttatttacagagaatcgtttcactgtatctcgactatgcggagttacaggcggaacgaagaataccgatgagtatggaggactgggcaaagcgacttgatggttttttggagtttaacgggaacgaactgctgatgggaccgggaaaagtcagtgcggaacaggctaagcttcatgcagagactgagtttgaaaaatatcgtattgttcaggatcgattatttatgtcagactatgataaatatttaatagaattagaacatcaagcggatcaaagtgacgtgtaaagataattataccgtttccgcttggggagaagtgtgctctctcaccatcattattatctactcaacaaatgtggaaagtattgtacggttgaagaaaagtgtaaaatagtgaaacaataaacagatttaatgggctggttgggatttgtaggaatatatatttgcagaatttttaataactggaaattagagcggaaggtaaggtgtctggtccgtgaatcgtgagattgaatatgttaatttggatgtaatacggtataaggataattaatggactagggaatatttaaacctataattttttgaggaataaagattgaggaaaagaaattatgacaaacaagaagaaagagattacaatccatagttcagccgctgagtatttaacatatgtagcatctacaggtcgtaactcagatagttttgagatgcgctatgaggacgagaacatctggctgacgcagaaaatgatggcaaccttatatgatgtttctgtatcggcaatcaatcagcaccttaaaaggatatttgaagatgatgagctggtagaagaatcagttattaagaaatacttaataactgcctcggatggtaaatcctacagtacgaaacattataacttacaggcaatcattgccgttggctttaaagtgaacaacgaccgtgccgtaagattccgcaaatgggccggtcagattgtcaaggattatacaattcaaggatggacgatggacaaagagcgcctgaaaaaagggcatatgttcactgatgaatattttgaacgtcagcttgaaaatattcgtgagattcgtctgtccgagcgaaaattttatcagaaggttacagatctctatgccacagcgtttgattacgacaaagatgccaagactacccggcagtttttcaaaatggtacagaacaagatgcattgggccgtacatcgtcatacgcgtgcaaatgccgaaaaagaacatatgggtttgacaacatgggaatcagcgccggatgggaaaattgtcaaagcagatgttactgttgctaagaattatcttagcgaaaaggaaatgtcctatttacagagaatcgtttcactctatctcgactatgcggagttacaggcggaacgaagaataccgatgagtatggaggactgggcaaagcgacttgatggttttttggagtttaacgggaacgaactgctgatgggaccgggaaaagtcagtgcggaacaggctaagcttcatgcagagactgagtttgaaaaatatcgtattgttcaggatcgattatttatgtcagactatgataaatatttaatagaattagaacatcaagcggatcaaagtgacgtgtaaagataattataccgtttccgcttggggaggagtataccttctcgccatcattattatctactcaacaaactgcgagacaattgtcgaattatgtcgaaaatagaaatgcatgaatccaataaaggacaggagaagcagccatgaaaattataaagaattgtattcaatgcaaagcatgtggtgaggtgattgaatcaaattccatatatgatttcgtgtcctgttcttgtgggaaatgcagtgttgatgggggattagagtatctccagcgagtagcagaaacaagggatatttttgtagaaatgtcgtagtttgaagaggattggttttttgctggctgtgttaaaatcggtaccagatgctccagagtaggagcaggaagcgaagaatctggaaaataaaatatgggaatctaaaaagcagaactatatcttgcagaaagtcctattggatggcgatattagttctgctatttttataaagtaacgtacttggaatgatggcgaactggattcgacatgccataggcggtatgaacaggaatggagatggcttaggtatcagcagaagttgatcagaggttgagaggttgatttctgctggcgaaggggatatcactaccaataattgtgttctcagacagaaagttgaggatttaattgttggttgtaattaaattgggataatatatagcaactttattattggtgtaatatcctttatagtgtataatatgattaatatattccttatcaaaacggttgttttgcctacgcttttctgaggggtaggaaagacgctcatccctatattgaaaacgtatgggggcatggcggtttgaatttccctgtcttccaggtgctcaatgatggtttttggctgggctcctttttctgcaaaaatggttccatgcgtattgcggagataatagctgtgaaataatggattgcccagttcttcgggtatgacctttgcacagttttttgaaagaaatttaacgtgtagagataatggtatgtttgtgttaaataccgactaattttgagtcggatagcgggaggatcttattgtatatgtttgagtttatgaagacattaacattacatgtgagctacgaatgtttaaagggcgggacacttcctgcctacttaggttcaacgatacgtggactcatggggcattgcattcatgaattctattgtcatcatagaaatgtaaagtgctttttgtgtgaagatagagggacatgccagtatgttcagtgctttagcaataccggtggcgaggcaggggcagtgaatccatatacaatctatgtatacggtcagggaaaggaaaaatgggagatcggagattactgtgtctttgacattaccttattcggcagtggaacagagcatgcaggagtctatctggacgcgttgattgcagcagaacagaaaggctggggagcggaaagaattccgttccgtctcgtgcatgttacggatcaggattccggaagattgatttatgccggcggaaaaagctggattcgcaacttgattcccagaacagtttccgtaaaagaacggaacgccgcatatgcctgcctggtttttgacacacccttaagggtggtctccggcaacaaattgtttcaaaaattgccttttgacatggtgatacagtttttgacccggagaatttctcttatgacagcaaggtatacggattttaacctggagtgggatatagaagagatgatgcggcaggccgcggagatcagaacggttggggagtcctggaaagagattccttttttcagatattctatgaaccagagggatgggaaactggaactcgcgtctaaaatgggttggattttgtacgagggggacttatccccgtttgtgcctgttctagaactggggagccgtcttcgactgggaaaaggtgcaacgattgggtttgggcattataatatttattacgataaataaatttaacgatagtgagcggagggatgaagatggcttgggttactacctacgatgagatattattgacgattgccaagaactataaggatattgagacatctatagtaaatcagcttttgttggaggttccgaaccattatcctacggaaggctcctacagagaagccgtgtgggaatcactgttcaaaatggttgttccaagaaaatactgtattgagcagggcgtatttattattgatgcgtttggacataagtcaagggaagtcgatctggcaatttttgatgaactttatacgccgtacatatttaattatggaaagataaaattcataccgattgaagctgtggcggcagtggttcagtgtaaaggtgaattcccagataagaaagcaattgaatcatgggaagaatccatcagtgcgttaaccacatcgatggactccgtggccagaatggcaacttacatggcggataatttggataatcctcatggcaggaagaatgatttaactcaaaccgcaacccgcccagtgaaaatattgtgtacacttgcaggaaaaaaatttttagacgaatacaaggaccgtttcgatataatcctgtcagtagataaggaaaataagaagttgtataaaagtataccaggcgaaatgcaaagtttagagaattggaacgattcaatgaatcatgcgatacatgggatcaaggatttacaggataaagaatacagagaaagcagaaaaatgagtttaacaacgaagagggagaaccttcttcaggaacttaaggtaccgcagacagttaacaatgatgaggaggaagagaatgtaatcctctctttgattttccaactgaaccagcttcttatggtaatcaacaatcccatgttgttcccgcatcatgcctacgcgaaacaattcagcgatattttaaagaagtccgagcaaaacaaaggagaaaatggggatgggaaataataaaagtgattatattttagcaaaatttgacgtcggaggcatccaggattacatctttgccacgaaccgcttgcgggaaaatgccggcgcctcttatcaggtgacaagaatcatggaagaatttttgcttgagtcatttcgggaagccgcagatgaggaaaacgtggaggtgctcctggactggaagctggcagatcgactgcgcctgccgcaagacgagaggatgatggctgaagtcatttatataggcggcgggaacgcagtggcattgtttcggaatctggaatttttttgcagggtgggagaaaaactggggattaaggccgcggtaaaatgccagggcgtctatttaacggccgcatacatcgagacggatctgtctgattttgcagcagacagaagaaggctggatcaggaaatgaatgaaaagaagaagcatatgatccgtcagctggtatactctccgtttccggttgtggaacaggaggatggaagccaccagccgatcaccgctcagatccattatgaaacggaatcggaaaatgtaacccggattcagctccagaagcggaacgcttataaagatattgtccattataaacgtctgtttccggtattggacaatggagtcagctatggatatccggaagagatggaccagctttccagagagtatggggaagacagcatggttgcggtcgtccacattgacggcaacgggatgggcgaccggatgaatgaacttctgggtgagcatatgggctatctggagggagttccgatcatacgcagagagtcgaagaaaatagcggggctttttgagaagacgtatcacgaggtacttcaggagttgtgggattgtcaggtcttaatcaggggaaacgggacagaagaggagcgcaggatttttcctttgcgacctatcctgatggatggggatgattttacatttatatgcagggcggagctggctgttccgattgcggcgggcttcatgatgaaactgttgcagatgcaggacggtgaggaaaagaaaataacagcctgcggcggtattgcctttgttcacagccatttcccatttcgtgtggcctattcaatcgccgagaagtcctgcgggcaggccaagaatgcgtggtatgaagaaaaaaaacagaagagaagcgcgatggcagtatgtttcttggatttccaagtgataaaagacagtgaggtgggattttcgcttaagaatagaaactatcagaaacgtccgtattctctggggattgacgaaaatagaaccagggacaattctttagagtcattatatgatgtattagttaagatggaggaggactggccatcggggcggctgcataaaatgtaccgcgcgtttttagaaggaggccatgcgatggaatttctaaagaaggagtttgtttcacgcggatataaaatcgacaatctggtgtcgggaagatgggaggattcgcccttatttgatgcgttagagatgcagggaatgtgccggttggatttggtgaataaatttttaaatatacagtgaggtcagccatatgagagaatggaatctgcgaattgaattaaaaagtgatttctgtaccgctaccggggagaatgcccccggtatgataagcagcaagactgcgctggaatacggaattccaaagattccggcaaagcgcatcaaaggctgcctgctggagtcggggagggaactggccgataacgggatgattgcgggagaacttctatcccgcatatttggttgtccggggagcttaggcggagagggaatccgtgtgggagacgggcatttgagccttgtacctgaatatctttttaatcaggagaaaaaggaaaactttatgatctgcgattatgagcaatttctaaagaacgttaaagattgtcaagatatagaggattcccttctggaagatatatttaccagaaaaaggacaaggacggctctggaacaaacgggaaccgcgagtgctcattcccttcgcacggtacaggtggttccctccggccttgttttttgcagccggattgagggaagcctgagtcaggaggaggaacaggcgctgcttttgtgcgcaaaaggtctgcgccatatgggaatcggtattaccagaggaatgggagaagttcgctgtacgttagaagaagcggcgcttaaagagacagggattaagaaagagagtactgcgctgtttcagacaatccatccggagcaggaggttagtctgccctacgaaattaagttaaaactgccgataattctggaaggaaactccggtgaggtggcggatcagattcagggaagcgctattttaggcgcgtttgcgggaatgtacataaaaaagtatttactgggagcgaatgcgcataaagatgcggatttctgtcggatttttttgcgtgacggagttcagtttggcaatgcgtttctcaaaaaagacggaagagagtatgtaccctgccccaaagcgtttgccgttctgaaggacgataggacggtatggtttaatacaatgaaagatgaggaaaacagaagaagaaaaaatatttccgaacacatctgcctgaaagacggctgcttatataaggcggctccggacaaagagattcatttccatcatgccaggccggcagaccgggcaatcgggcatgcgcaaaatgaccgggcggaggacaaaaaaaacgctgccgggcagttctttcagtacatggccttgtcggcagagcaggtatttacgggtactttacggggaaaggcgggcgatattcaaaggctggttgagtgtctggaggaaaacggatattgcctgatgctgggcaaatccagaaccgcggaatatggaagctgtgaatttcacattacaaaaccctctgctgtggagcggaagtatggaaactctgcctgtggaaaagactggctggtctggcttataagtccgtttgtttctatgagtcaggaaagcggtctgtttgaaacggaggcaggtcctctgatggaagagatgagcaaagcgttgagttgctcgataaaattagagcactccatttgcagctgcaccgttctccaggggtataacggcagatggagactgccttcggcgcctaatccggccctcgctcccgggagcgcattccatattaaaacggacagggacgtggaggcttgggaaatcgaggagaagcgctggggaatgatgaccggaaaaggctgcggacaggtgaaagctatgccctggaaggattgccagaggggaataatcgtggaaggagaaaactcaaatccggatcaaacctggaagggagacggcccgggtgaagaagatggtggattacttgcagcaattctcgaatatcagagacggcgccttgggtgggaagaggatgccgggaaagtcctgaacattatggacaagcaagggcaggaactgccatcctcgtcggatattgttctcttgattcagctgctgaagggacggaatggaaaaccgggaacttataaaaaaattaaagaagaggttgagcggatccacggggaggaaaaaaagcagcgcattttgacctttataaaaccgtgtgagggcgagtctgtggaatttatggagcgatatttagaggcggccaagtggaaggcgaggagggaagaaaatcatgagtgatggcgtaatcagctttaacaagatatgcggccgtctctgtgtggagatgacggggcacttagcttctccgctgtctattggctccggagaagaggagcattcggactcggacgttgtttttcgggcgtccggggaaccctacataccgggtagttctctggcgggggcgctgcttgaatattcggcggccataaagggggaagaggaaacaaaaaaaatgttcggaatgcccagaggcggagtgcccggcagcagggatgacagacagagcagaatttttgtctatgatgcacggatagggcaggcggaagtgggaattcgtgacggcgtgaagttaaatgaggataaaacggccagccatatgggcaaatatgagctgcagtttgttgagaggaatgccccgataaagattcggattgagatgatagagcgggaagattgttttgaaaaagcaaaatccgaaattacggggagggagaggacagaggaaattgagcaggtctgggacagagaacgtcagtggatttatctgtggctgaaaggatttgagagcggggaactgcggttgggggccagaagccgcagaggatttgggaaaatagcgattgatcacgcccgtgttaaggtatttgatatgaggaaaagtgattcttataaggaatggctggactgggattgggagcaggcggatgcctttgaaggagccgggagtgagacgatccggatagaagacctggaacaagcaggcggagccgggagggaacattgtctggaggttttgctccgtatttccggtacgctgttggtccgcacttatgccgtggcctttacaaggacagaggatattccggattatgggcagatgacggttggcggtcatgggaaacaggcggtgatacccggcagcagctgggccggggctttccgcagccacctggtgaagactgtgcaggagcttttgcggcagccggactggaaggaagcacagaagatattaaacccattgttcggaacatggggtgatacagagatgagaaatcaggagcttcatgcctccgggctgatatttgaggaaacggtaattgacggaggtcatggcttacctgttgccagaatcgcggtagatcggtttaccggtgggacggtgcagggagcactatatgaggaaatcccatggataggaggagaaatcattctgccgatacggtggaggaagaatgggctaaatctgacagacgacgaaatctgcggtttgcttctctgggcggtcaaggatttgcaggcggggattctggccgtgggcggagagacctcggtgggcagagggatttttgaaccggtacacgggaaagacaatctctttttagatggagatgttttgacggatgaggatcagaaacgttgtatgcaggccgcggttttgtgggtgaaagggaatcggaagaaagagaatacgaggtgatggagcaatggagaggtatgaaccgtttggtttgataaccgaacagaaagcaagaaagaagattgccgaatgttttcccaatacagcaaccttgtatgcagttttggattatgccgtgtgctttggcacttataatcaaggcagcttttccatgggcatagaggcgcagacagagccggcggcattggattggacttatctgcgggaactccgtgttttcgacgaggagcaggaattgcttctggttccgtcaggcggtaactggatcgggagaatgagacgggatataggacaatataagaaaatgcaggatgatggagaatatgtcatcgatgaatgtcagaaactctggggaaagacgaaaaagtcgtataaagtaggggacacggtctggagccttctggtgtctggccgtggaaccagaatacagataccgatggatttgaatgagcgggaggaggcggcaatccgtgtacgccgctatatgcgtattcctgacgtgaaaaaggatggagcgctggtgtttcagaatgatatccgcatgatagggctgtgtccgtgggaaggagatgagtgagatggcgggaaaatttgtagagaattataaaaaacgatttgtcaatccgtacaattttattcctttgatggaatcatgcagccgttcggtaccgactgccgaatttgaagattgttatacgggatattttgactgcagaataaaacttctgacaccgctgtttataccaaatacatcatcttcttcaagactgctgagcgaggaagaaaagagaaatgaaaagtgcaaggacgaaaagtggaaagggtatgatttctattcttatgatgactggtcatcggaggaatgggaaggaaagggtctgcctttgccgccgcaaaatcctgcgattccgggaagtgagatcagaggggctttgcggagtgtctttgaagcggcatttaacgggtgtatgtcttctgtatccgtagatagggtgctttcacgaagaacgaataaaccaaaaaaaccgggaattttgaagaaaattaataacgaatgggtgattataccatgcaagcgggcgatgctttttattgggaataaagaaagtacaattccggatgaaaagatgggtattgcagttgggagatataggtataatcattggaaggaagggcaggagatatgggttaaatttggaaacgatcagtttacaaaagagacacgtaaaggcagtatcaaaatagcagaagtggtaaatcagtatgaagtaattgagaacagcagcctaactcattataatagaacgaaagaggagcggagaagggaactgagaaagaaaggatacgtgcaaagctggcttcataaaggtgagcggtttgctcataaacaccatgaatcagttttttatgactgcaatgaatcagaggaagctctcataagagtgaatcattctttggatattgacagcctaaaaataatattggagcaataccgtgatttggggaaaaaccgcaatattggcagagatggcaaatggtatgacggctatgaggtatttgagaggggaactcttgtgtattatagtgaggtggaggatcacgtttacctgtctccggcctgcctgggaagggaagtatttacaaagacggttggggctttattaaaagaaaacggtggttacgatccatgtgcggatgagaaactttgccctgcgtgccaggtatttggaatggtggggaaatccgggaacggcaaggcctatgcacgcgcctcaaaagttagggtaacggacgctgtgctagttgatccggcaagagacatcggggaattgtttgaggaaccggtggttcttccggaattgggggagccaaaaccgggaacggtggagttttatacggagccgccctatgagccatcagagaagtggaaaaaagggcagggattctggacatatgattataaatataaagttcagaataataagaaccccagtaatatgcggattttaagcgtcagggagccaaaactgcggggaagaaaatattattggcacagtcaagtggatttggaacgatatagggggaatcagctctctgcaatgaaacagagaatccgccctatgaaagcggtgggacgggacgaggagccgttgtttcgtttccgcgtgtattttgaacgccttaacagaacgcagttgaatcagctgaaatgggcgattgattttggaaatcctgcctgtgcccataagatcggcagagcgaagccgctgggattcggcagtgtccggctgagcatcgacaacttgtatctgcgcgaaattgacaaaggtacgggaatctgggaaatgaaaagagagacgaatatagacaactttttttcacatccggtcgaggcgagcgaggcccttaggatagtacagaagatggctaactgggaagaacggcctcggaatgttcaatatccatccgtggatccgggatcccatggaaccccgtataagaaaaacgagacagcatcccatcagtggtttaaagaaaataaaaaggatggttatttcatgaaagtgctcccgaaggcggatgaagatgcaaggaaaaacctggagagcgaaaaagcattatatacttatacaaggaacaaaaattaacctcctgtgcggtaaaaagcctttagatcgacttaggaaatgaaggaggtggcaagaatcacataggattcacaggattgaaagagggctgatgttatgggaggaaaagaggcattacggggatttttatatcaaggatttgcttccgtccttgaggctttatgccacgagggctgggataggatttatattgagttagattctaaaaatgataaggtcgacattgcgttagaggcaaatcacgtaatcgttaaaagcattcaagttaagtcaacaatcaatatctttaagaagattgaaagttttcctcccaacgaaataaaatcggaggaggaagcggaaatctgtttatcattgacggatcattttaaagaccgtaagcttaaagaacaccttgattggaatcgggatatttatgaaaaattagaatcgtttttacggaccaatacggataagaaacgtgcctaccaattactttggagtacacattgcagcattgcttttgctgccggcagaatcctgaacagtaaggaggggattaatatcttcccggtccaaaaaacagctactcatggaacagaactgtgggatgtgaagctctcaccgggaagggagtatccgaagtggaaaatttcagattcaggtcctgttgaaaataagtatgatacagcgttaatattaaatgttactcgaaacatacacaatgacgtgataaattatgtcgaggagagtaacatacctgttggacggttgattgactgcacgctggaggaaaatggcgccaccaatttttcggtacaggatggtacacacgcctccctcctggctaattcgatttatgatgcgattggaggaaggaatatggcggagcgtcgggcagtgttgcatatttttgctgctgcaccaaatgcattgatgtttttcttgggtcaaaattcgatgggatttggaaaatgtattttatatgaatatgattttgagaagaggagtagctgtacttattcgccatcattcgactttacaaattaataggtgcggcgatatcacgatatctgggaaaaggcggattttgcggtgactggaaaagaatatccgaatcacttgattttagagaggtaaatttgtcgctttttagaaatgtttaaaaatttgtgggtaggacttgaggagcaaaaacttcaagtcctgcttttcaggctctttgtcaatagttggggtgggatttgttaaaatcccgccccaattctatgaaaagggccctttttatgtttagttccaggttttactgattttgggcatgccaaataagcctccgcattaccgacctttttatcctatgatgtacagtgaagtatccgggttcggaaccgtttgaaattccggattccgtagctgctccgttttaatacctttatcttgttgttaaatccttctgtgggaccatttgtcagcccgtatttaaaggcattcaggatttcttttcgccaggccctgtaggtcttagcacaggcctcaaattccttgatcccacagctctgtgcattcgcaatccagtcatcaaattccctctgctgctgacgatacgcttccatctggcagatatcatagaaccactctttcatgcggtgtgccagacgcagatcctcgctatagtgaagcattaaatcacaggcctgtttgttttcatccttcagctttttatagcgggtcagaatgagtttccggctgcgtttataatacttacgcagagaaaccggcatggaccgctgcagccgtttgcgtacattttcaatcgcccatgtcacctgccggatgaaatgatatttatccacgatgattatagcgtttggaaagaaggtctgtgcaggttcggtgtatgggcgccacatatcgcagacgaagaactttaccttcaggcgttctttcctgggaatgttccgccaataatcagccagatggctttgggtccgatccgggagaatgtcgaggatccggcgctttttcggttcaaccagaatgcactgatatttaccggtagaagcattgcctttgaattcgtcaatggaaagcgcttgtggaagctggtcaggcgcaggattacttgatttcccagtaagggaatgtcctggacttcttgtaaacggtaatcatgaatccgttttgttttagccccacagcagggacaagtctgttctaccggttgggactggatgaaaattttaatgaaagagtctgcctgaaccacttttttaatagaaacaccttccaagttaaggaaagccttggtttaattagggtacatctataaggggtcatctccataacattaaactttggtcgggataatgcgttaggaggcttcttatagatgtattttattacaacgaaaagaatgatggaagtgtgcttttcagcaccccccaacatatagtatagaacctcccggcgctgtttttcctggtagcggcagtaaaagggggaatcggcggcggagatgtgaaactggcggcagcttgcggccttgtgctggggctgccgggcgccttgatggaatgccaaatgcagaagtgtatgtgtttgaggaatacggggaaatccaggggttttgtcggaatggatgcagaatacattgccggattatttgtagtggaaggacatcaggggcatgggactggtcatcaactgatatcagaggtaaagaggaaaaatcgcctgtcgctgcatgcttatgaaaagaatgcaggcgcggtggcattttatcaggcagaaggattccatattgaaaacagtatgacagagaaagagactggggaacaggagtaccggatggtgtttcatgagagcgatgaatcaaaagaatcctgcagtaaatgataaagaagtcagaaagggggcggtttgaagatgctgattaattttaaggacatggaaatgcgggaagtgccagggggggaagtgtatgcgcaggtgatgaagagttagctccttttttgcctgtaatagataattgcagaataactgaaaaaggtagaacgttcaaaagccgctgtcagaaaaatagagccggcaggaaacgtgcactggggacgtatggtgacaggggagacatttataactgatgaaggacggcagaagattaatgataaatttgcgccttttacggtagatatggaaactgcaagtatagcccatgtatacaatgtaaacaggataccatttatttcaattcgttgcattactgacaccgatgcctgcaggggaatgtgtaattttgaagaaaactgcgccaaagcctcaagggttgcaaagaatattacagtggatttattaaacgaacttagaggataaaatcagaaattgttctgttggtgaggaaactaaattaggtggataacgggaacttatgaggaggatatggaacagtatgaatagatagatgtgcaatgattgacagcgcaggtttcgtgggcgtaagacagataatagatatactgacagtggaaccgatttttgatatgcttgtggatcaggaaaagaataatgaaagaggtatatggaaatagaagtatttcgtaattggcaaaataaatacggtatgcctgatctaaatgatttaacatttgctaatacagaacaaaagtgtattaaatacgatttcagaaaagaatttggaatatgtggaaaaaaaccttatctggaaaatgaatgtcaaattctcagataagggttttttgaaaaattgcttttaaactcttttcaatccacaagtggtatattgctacttgacattataaataatagcatagttaaagagcaaaatcaaattttactttaaataaatacactcgagttaaaaaggatataaaataagccaaagcgcttgaaagcctgttaccaatagagtataataaaaaatataagttaacagtaaatttcttgaactgcaaagaggggattaaagattattgcacatagaaaagagtccgatggaaaggagcaggattgggataaacacagttccaatgtggcaatcttatgcttcctgacggctgaaaagctgggactgggtaaactggcaaaattaatggggctgctgcatgattttgggaagggaactgcagatttccagaactatcttcgtggagcaggcagcaggcatcataatcacgctggattgggtgcgctttatgttcatcggcattggtggcagagggaggcagcgaaggagagaagacagactgctcagctgatttctttatgtatttacgggcatcatgccggtttgccggactgcctgactgcttcgggaagatcgccctatttagacggcctgcgggaacagccggagaattactacatagaagcaatggaaaatttttacacggaagtggcatccgcagagaaactggacaagttgtttgatgatgcgtgtaaggagttgaaggaatttggactggacagccattctttcaactggggaatgcttgccagacttttgctgagtattcttgtcgatgcggacagatgggattctgcgtgttttgaatatgatgaagacccatttgaaatggcacaggaagctcagcctgattgggaaaaacttcttataaaacttgaagcttatgtggaaaaattccccagagaaggagaattggccacaattcggcgcaatatatcagcatggtgcagagctgcgggagaatatggaccggggatctataccttgtcggttcccactggaggaggtaagacgttttcgagtctgaggttcgcgctctcccaggctgagaagtataggcagcgaaggattttttacctcattcccatgaatacaatcttggaccaaaattcaagagatattcgggacgcgctttccgactatccgtcgattttggagtttcattctaatgttattccggagaatgaagcggaggaggagaactatcgcaggctgacagaacgtttcgatagtgatattattttgactagtctggttcagtttttggatacattttttcagaagggaaacggcaaggcgaggagaatgtaccgatttgcaaactccgttctgattttcgatgaagtccaggctcttccgaagaaatgccgggagctttttaagctggcgcttcaattccttgtacgtttttgtaactgcacggtgctgctttgtacggcgacgcagccgaatcttggattagaggcaaaggaacttgtaccggatgtgtatgcgctatatcaaaaattaaagcgggtgacatatatttcagagatgggaccacgtaaatatcaggaggctgccgatgatattgcgggatttatcgggaagaaaacttctgtgctgatgattgtaaatacgaaggatgctgcctggaatatcttccaggggatttctgaacagttggagacattaaattacaggcaggtacaaatacgacaagatcttacggacgaggaactggaaaaatgtgccggaggctgtgcggaagatgagattttgtgtgtgcatctgagtacacttatgtgtccgatgcaccggaaagagatactgcgctggatcaaggtctggctgtcaaagaaaaagctggtctgctgcgtttccacagccttaatcgaggcgggaatcaacgttagttttccaactgtaattcgcagcttagcaggtattccaagcctgattcaggcagcagggcgctgtaaccgcaattgtgaagcggatatgggaaacgtatacttatggaatcttgcagaggagaggctgagccgtttgccggatatacagaagggcaaggaaatcagcatgagcctacttagcaatgtggaaaatccggatgaactgggaaatccggagatgataaaaagatactttgcgaaagaggagatatatacacaggaagttgaaaaatatccatacaaagagtggaactcggatttggttaccatgctgtcaaccaaccgtgagtgccggtgcacagccgggaatttgcgggatgagaataatccgctgcccgatttaagtaagcggttttatcagagttttcgaacggcaggcacggtttttcaggttatagaccagaaaacgaaaagcgtaatcgttccctatggcaaaggaaaggaattgatagaaagattgggagatcgccatacgctcagcgaggagatcagacttttaaaagaggctcaacagtacagcgtaaatttatttgaacatatttttaatcgtctggccggggagggcgctttagtctctctgggtgagacaggagcagttattttaaaggacgaatactatgatccgtgggctggagttacgattacgccgcaggaaatgaaggagctcataatgtaaaggagggatgccgtattgaaaatcagaaatcagattgagtattgcgtgtcaggaaactatgcactgttcagcgatccgattgcaagaatgggaggagaaaagttcagctatatgcttccgacctatcaggcgctgaaaggaattacggagagtatctattggaaaccgtcgatcatatgggttgtggatgagatgaggattatgaaaccaatccgtacagagtccaaaaatatccggccaatcagctatgtcgcgccgaagaatacattgtctgtctatacctatctggcagatgtatcctaccaggtcagggcacattttatttttaatgagaaccggcgggaagagctggaacaggattttaatgaaaacaagcaccacaatattgcgaaacgtatggtggagaagggtggacgcagagatattttcctggggacgagggagtgccagggatatgtggagtcctgtgtatttggcgagggagaaagctattatgaccattatggagaactggaatttggactcatgtttcatgggtttgattatccggatgagactgggcagaatatcctggctgccagattctggaagccgaaaatggtaaatggagtggttcagttccttcctcctgaagagttaccggaagagatgaagcggaatatccgtccaatgaaagcgaagcaatttggagaaaagttcggtaacttcagcggtttgaaggaggagacactgcagcgggagttggtctgggaaggaggggaaacgaatgagttggatgcagaaattatgcgaggcgtatgatgccggtattgtctgtgatcagtcgaaagaatcggttcggcttgttccgctggggtttgtgcgtaaaaaagtaaaataccatgtggtactctcgcgggacggtcagttcgtatctgcagacgagctgatggatgaaaatcaatttctggaaattccaagtacgccgcaggcagagagccgtacaggtgataatggaactccgtttcccctggtggaacagctcaagtatctgatttttgaagatgaaaattcgaagcggttcagccagtatatggaacagctcagggcatggtgcggacagcccgatgcgcctgactgcctgcgtgtggtatatacatatctggatggtcatacattgcttaccgatttggaatcacagccaaatttgaaagtgaaatattataagaatgcagaaaggcgggaaggcacaggagaagacgctaaggctatggtctgtttttcagtccagatgcaggatgaaagtgctgacgatctatggctcagggcagatgtcaaacagtcctgggagcggtttctggcagataaactgccgggcgccagagcgttttgctatgtggaaggtaagatgcttcctgctatggagaatcatccgaagctacagggaaatgccaagctgatttcggcgaaggattctgaatttccatttcagtacaagggacgttttgtggaagaccgcagcgcggcggtgattagctttgatgcgtctgtgcgcgcccataatgctctgatctggctcattgcacgtcaggggatgcaaaaatacggtatgacatgggtggtgtggaatacgaacggggcggtcatgaaggctccgattgatgaaaaaaacggctttatggatgatgaggaagaggaagaagactccgagccgattatcgatacatttgaaagttatgccagggaagtgagggcggcagcccgcggttatggcggcagactccacgattataataagcagcggactgattttgcggtgatactaggactggaggcggcgacggacggaagaatgtcggttacttattatcaggagtgctctggaaatgaatatgtaaagcgtttggaagaatggtatacggattgttgctggtggagttattcctggaaaaagaagacaaaggagattgcttccccgggtccggagcagattgccgttgccgttatggggccagacgcggtaaatgtggcaaaacgggataaaaaatgtgagaagtcccatacaaaattgatgcggaaacttcactccagaatccttgtctgcattgctgacaggcagccatttccgattgatgttgtcctcagtgcattttaccgggtatgtgcgcctcttgcgtttgtcagcgggaaggaccggcagtggtccagaactgcatgggaaaccagtgttgacactgcttgtgcgatgatatcttgttttcaaaaacgcagtcgtggggagatttgcgaggtgttccccccagaactgcaggccgagtcgaaaagaagagactatctgtatggccgactttttgcagtggcggactttatggaggagaaatcgacggataaggggcgggattacccgacaaatgcgatacggctgatgtgtcagtttgtgaaacggccgtttgagacgtggcctaagatccatgaaaaactagttccctgttttaaaagccttggccctgacagcaaacggtaccagatactttttgcgaaaattgaggaacagtttacggaagaagacagatatgagagaggggagctctcgctggagtttttgcagggcttatccagtcagagacagatgctttttcaaaaatgggaacctactgaaaaaaaggaagatgggggaggcgttccatataagcttccaaggcggcgttccgaactgtacggatgtctgctggcgatagcggatgtcgcggagcaggaagccagtgagggagaacggacgggaatgaccaatgcgatgcagatgatgcaggtatttgcggcaaggccctatgagagctggggaagacttcacgacaagttgcagccatatttggaaaaattgggcaagaaggcggattattatcagcggttgattggatttgtggagatgcagttttcacaagcagatcgggaaacggcagtgccgttagacgccggctatctgcatggatactattgtatgcggcagacgttctatcaaaagacacagttttcaagggaacctcaagagtgggaagaggcaggagacagaaggagcgccctgtatggacggcagcttggaatcgcggaccggatagagagaaggcgttttatccgtgaggcggaggatatagacagacgttctacgaatgagttgagatttatgccagtctttgcccggaagccggcagctacatgggaaaatctaaaagtcaagttaaagccatatctaagatatgcggaaaacctttcgggagaagacttggccaccctggaacagttggaagcgcaactacagcaaaacggctggaatacggatattcctttgggaagtgtttatctgcattattactatgaagaacgaaatagataaaacgaaatataggatgaaaaggagaaatgattatggcagctttgaaggagaaaattgattttgcactggtttttaccgctaaaaacgcaaacccgaatggggatcccctggatggaaatcgcccgagaactacatacaatgggttgggagaagtgtcagatgtttgcctgaagcgtaaacttcgcaaccggttgctggacgaagggcagaatatttttgttcagtctgatgagcgccgcagggaaggggatacgtttcgatctttaaaggatagagcagacaatgaacctgcgttggcagcgtgtgtgaaagagatgaaggcagggaagaagacacgggaggattatgccagacaggcgtgcgaaacatggtatgatgtgagagcatttggacaggtttttgcatttaaaaaagggaaaaaagaggaagaggaatcggatgccgtatcaatcggtattcgcggtcctgtcagcattcagcctgctttcagcaaaggaccggttaatattaccagctcccaaattacgaaatcggtgaatcttgagactgggaaggatccggataaaaaggggccggacaccatgggaatgaaacaccgcgtagattttggcgtttatgttacctacggtgcggtcaatgtccagcttgcggataagaccggtttcagcgaagaagatggggaggctttaaaggaggcgcttagaactttattccgtaacgatgagacttcagcccgtccggccggcagtatggaggtagtgaagctgatatggtggaaacataactgcgccagtggccagtattcatcggctaaggtgcatcggacgctgcgggtttcctgtgacgcagagggcaatgtttcggtaaatacagaggatttggagggcctggttccggaggttttggatggcgaatgatgattcggattttttgatgatttcaggattaaaacattttcagttttgccgcaggcgctgggctctggttcatattgaacagctatgggaagaaaatgcgctcacgttagagggacattatatgcatgaacgggtgcatgatgacggttttacggaagcgagaggctccgttcttttgtcccgcgggatgcctgtccgctcccaggagctgagaattaccggtgtatgtgacatggtggaattatataaggatgagggaggagtcacgattcagggaaggaatggccgttggaggctgtatcctgtagaatacaagctgggccagccggatttgcagggagcggatgcgctgcagctatgtgcacaggcgatgtgtctggaagaaatgttcgtcacggatattccggaggctgcgttgtactatggaaagataaaacgccggcagcgccttatcttaacaggggaattgcggcaaagagtgaaggagtctgtggcggagatgcataggttgatgttagatggccgcacgcccaaggcaaagatgggaaaagcctgcaaaagttgttctcttgtagaaatttgtcagcccaaactgatgaaacaggtttcggcatcggaatatatccgcagggcgttccacggggaggatgaggaatgaagaagttactgaatactttatatgtcacgacgccggatgtatatctgtcgctggatggagagaatatcgtactgctgcaggaacaaagtgagctgggccgggttcctctgcataatcttgaaagtgtggtctgcttcggttacagaggcgctagtcccgcgttgatgggagcttgtgcagaaagggggatcggcctttgctttctgacgcagcatggccggttcctttccagaatttccggaccagtgagcggtaatgtgctgcttcgggagacacagtattttagagcggcagatgaaatgcagtctcttgcaattgctaaatcattcttgcttgggaaaatttataatggtcggtggagccttgagagggtgaaacgtgatcatcccatgcggattgagcaagagaagatcaatagtgccataactcagatgtgcagttctctgagtgatttggagaaaggcaaaaaccggagtgaactgatgggaattgaagggattgctgcgaaagcatatttcggagtcttttcgcagatgattctgcggaatgaggatgtatttatttttgatggcagaacccgtcgtccgccgctggatccggtgaatgcgatgctctccttttcgtacactttgctgggaaacgagattgcaggtgctctggaaacggtcgggttagatccggcggtaggattcctccatacagtgcgtccggggcgtgcgtccttagcacttgatttgcttgaagaattgcgggcgccgttggcagatcgatttgtaattacgcagatcaatctcggcatttttacggaaaaagattttcaaaggaaagagaatggtgctgtttttatgacagatgatgcgagaaaaaccttcctgtcggcctggcaaaaacgcaagcaggagacgatcatgcatccttacctgaaagaaaagattcaatggggtatggttgctttttcacaggccatgctcttgtccaggcatctgcggggagatttggacgcctatcccccgttcttatggaaatgaggtgatggatttgctcgttcttataacctatgatattaacattacagaagccgcaggggcccgccgtttaaggcgcgtagccaagcaatgcgtaaattatggcacacgggtacagaactctgtttttgaatgtcaggtggatgcaacgcaatatgtgaagctaaaacatcttctgatgaaagaaattgacgaagaaaaagacagtctgcgtttttactctctaggtaatcattatagcggtaaggttgagcattttggcgtgcggcgcggaatacaggtggatgaacctttaattttataaaagaaccgcagggaagatgtcttgccttatcagtgcgaacccgaagtgaacatgaattctgtgggaggttcgcacctggattttggtgtaaattggaggggattctggtttagagataaaattaaatatcatatttggatgatttgaataaaaagtaatgtaaaaaacactctaaaaccatgaatttttgctggtcaggctcgtaagagcctgtggatcgaaacttctaatcttaatggcattaccagatataatagggtcaggctcgtaagagcctgtggatcgaaacttctaatcttaatggcattaccagatataatagaggtcaggctcgtaagagcctgtggatcgaaacgcaaatcacatcacagatattaatagcgctgcctggtcaggctcgtaagagcctgtggatcgaaacatccatgtctgactaatataaaatgttgttccagcggtcaggctcgtaagagcctgtggatcgaaactatctgagctttttccaataatattaaaactatggtcaggctcgtaagagcctgtggatcgaaacagaaaatgtcaattggcaaaattaaggaggaggtaggtcaggctcgtaagagcctgtggatcgaaacgttcgtggtggaatgtaataattgtgtcggtcaggtcaggctcgtaagagcctgtggatcgaaacaacgtccatagctgcgtcaaacttagcgttaagtggtcaggctcgtaagagcctgtggatcgaaaccgttcccgaactgtccagctataacaagtaatgctggtcaggctcgtaagagcctgtggatcgaaacgcaaataacatcacagatattaatagcgttgcctgggtcaggctcgtaagagcctgtggatcgaaacacctgtctcagggttaatcacatctgatgattcaggtcaggctcgtaagagcctgtggatcgaaactttgaaacatttgttgctgtaggtcttgcagttcggtcaggctcgtaagagcctgtggatcgaaacagttcgtatcatttttggtaactaaaagagaagaggtcaggctcgtaagagcctgtggatcgaaacgttcgtggtatgtgtggggcagggtatgcgcgcagggtcaggctcgtaagagcctgtggatcgaaactcctatagaatgaaagatgtgaacgtcttctgtaggtcaggctcgtaagagcctgtggatcgaaacacgtaagtactgataagaaagagcggttagtgagggtcaggctcgtaagagcctgtggatcgaaactccaaaaatgcggttttccaactggatatctattggtcaggctcgtaagagcctgtggatcgaaactaatgcttcttttactactaaaacatcgtttgctaggtcaggctcgtaagagcctgtggatcgaaactttaaatctacatcgtacaacggattatattcatggtcaggctcgtaagagcctgtggatcgaaactttaacattgtatattggtgaagcccccaagttggtcaggctcgtaagagcctgtggatcgaaacgttcgtggtatgtgtggggcagggtatgcgcgcaggtcaggctcgtaagagcctgtggatcgaaactttaccccagcatgatgcacagtatgtcaggaaacggtcaggctcgtaagagcctgtggatcgaaaccatcagagagattggcgcaattattatggattaccggtcaggctcgtaagagcctgtggatcgaaacaatatcatgtcactgtaactgcctgacccctgttggtcaggctcgtaagagcctgtggatcgaaactacttcgcaagcgaaccagctcagtccagctactggtcaggctcgtaagagcctgtggatcgaaactaatctacccgtaaagttagttgtgtctaaaactggtcaggctcgtaagagcctgtggatcgaaacgtcaccatacactaacggtaacacatgctgcgtccaggtcaggctcgtaagagcctgtggatcgaaacatcacttactagacgttctttcttgtcggtgctgggtcaggctcgtaagagcctgtggatcgaaactaatctacccgtaaagttagttgtgtctaaaactgggtcaggctcgtaagagcctgtggatcgaaacacttctagcattgtttgtagcataaatgaagttggtcaggctcgtaagagcctgtggatcgaaaccgttttcccagcggtataattcaaaccagccattggtcaggctcgtaagagcctgtggatcgaaacacgaagtctcggtaagtcaagatttccgaagctgggtcaggctcgtaagagcctgtggatcgaaactaaattctctggcacaaggttatcgccaattacagggtcaggctcgtaagagcctgtggatcgaaacacttccagcaacatcaacccccagcgcacccgcacggtcaggctcgtaagagcctgtggatcgaaacatatcggtattttacttcacttctcgcattgtttggtcaggctcgtaagagcctgtggatcgaaactttgactgtaactatatcatgtggcagaacccatggtcaggctcgtaagagcctgtggatcgaaacctacaagtattgttaaaatacttagaaacattcggtcaggctcgtaagagcctgtggatcgaaacatcgaacatagggaagttgaagttaaacaccccggtcaggctcgtaagagcctgtggatcgaaacaatcatctgctgaatatacgttggaagattgttggtcaggctcgtaagagcctgtggatcgaaacaagatattcacggattccataattaaccccgttgtggtcaggctcgtaagagcctgtggatcgaaacacaaaccttgctatcagcatgtttgaatggaaaggggtcaggctcgtaagagcctgtggatcgaaactacaaaacagatgaagcattacttaaagctgtaaggtcaggctcgtaagagcctgtggatcgaaaccacaatacaccacgtttccatcaggagcagatatcggtcaggctcgtaagagcctgtggatcgaaactttgtaagtcgggtcatttgcaaacaattcacgaggtcaggctcgtaagagcctgtggatcgaaacaaggaagagcttaccgctttagaccagattccttgggtcaggctcgtaagagcctgtggatcgaaacagaactaccgggactatgttccgaaagccacgccgggtcaggctcgtaagagcctgtggatcgaaaccggcatgatggggaacattcagaaggaatccacggtcaggctcgtaagagcctgtggatcgaaacgtgataatcaacaaagtcttcagcatattcttcgggtcaggctcgtaagagcctgtggatcgaaactacagtgcaagccctaagaaaaaatatcttataggtcaggctcgtaagagcctgtggatcgaaaccacaatacaccacgtttccatcaggagcagatatcggtcaggctcgtaagagcctgtggatcgaaaccttcgctgcgctagttcgtgggtgaatagcttaagggtcaggctcgtaagagcctgtggatcgaaacctgcaaccgtggtaataccgctaagaaccccgcggtcaggctcgtaagagcctgtggatcgaaacagaactaccgggactatgttccgaaagccacgccggtcaggctcgtaagagcctgtggatcgaaacactagacactgtccatacaacagatttaggtgcggtcaggctcgtaagagcctgtggatcgaaacccgcttctcccggtaagtggtcggcaccgatacaggtcaggctcgtaagagcctgtggatcgaaaccgtgtaacaatacgccggcatcaccgccgaccaggtcaggctcgtaagagcctgtggatcgaaacttcttttccatcaaattgcatcatacccatacaaggtcaggctcgtaagagcctgtggatcgaaacccgaatatctagcagattgttttttaaagaacttggtcaggctcgtaagagcctgtggatcgaaacggtacactgtccggaatgatgtcagcttggccggggtcaggctcgtaagagcctgtggatcgaaactggatttaacgggattggacgatatgacgctggggtcaggctcgtaagagcctgtggatcgaaactgacgcccatgtcattagccgtccattctccgcaaggtcaggctcgtaagagcctgtggatcgaaactgaaaattcgtattccggcgtcgtcaacaattccggtcaggctcgtaagagcctgtggatcgaaacaaacattcttcgcatagtctcccaacgctcttagggtcaggctcgtaagagcctgtggatcgaaactttctccgttggcagtccgtacccggttgccatcggtcaggctcgtaagagcctgtggatcgaaaccgtccagttcggcggtgcagcctgggccgaagtgaggtcaggctcgtaagagcctgtggatcgaaacggagtgaacgcacctttgaattgtacgttttatcggtcaggctcgtaagagcctgtggatcgaaacatatgatcgtgagggctgcacagatatagagagagggtcaggctcgtaagagcctgtggatcgaaactcgccgggtcatgaaaggggaatgatggcaagaaggtcaggctcgtaagagcctgtggatcgaaacctccatcgatatgatctgattgtgttattttaattggtcaggctcgtaagagcctgtggatcgaaacccttttcagacctacgttacaatttataaagatggtcaggctcgtaagagcctgtggatcgaaacgggaaaattgatagggacggatgcatgttcaaccggtcaggctcgtaagagcctgtggatcgaaacccttatttcatttggactatatttcggccttttgggtcaggctcgtaagagcctgtggatcgaaactgcgatgaatgcaggcaaaaggtccggggcaagggtcaggctcgtaagagcctgtggatcgaaacccgccacacagaaggaggcccggcccgtctgtgggtcaggctcgtaagagcctgtggatcgaaacgataaacaggtgaaggccctggacagcactattggtcaggctcgtaagagcctgtggatcgaaacttcccattgacacatgcatgttatggtgatatattggtcaggctcgtaagagcctgtggatcgaaactgtcacgacaggacggtttccgttatccgcttcggtcaggctcgtaagagcctgtggatcgaaaccggaactaaggtcgctacagcattatatttctgtaggtcaggctcgtaagagcctgtggatcgaaacagtgtggcatatatcttctttcgctggtcgatgggtcaggctcgtaagagcctgtggatcgaaaccggcctccgtgcctgtagaatcagcgtttcaaggtcaggctcgtaagagcctgtggatcgaaatgaagtgctataataaagttgtaacagtagtggctaataagatatactaagaataatcaggaaagaggtctttattatgccacaaaattacacacccgagtttaaaaagaagattgttcgccttcatgaagaagagggacgcacctacaaaagcattactgctgaatatggcgtatccaaagccagtatctccaaatggtgcgagttattccgtgaagaatgccagttaagccaggaatctaaagaagaatacgactacatgaaagaaatgctcaaacttcgaaaggaaaatgaggaacttcataaggaaaatcttttcctaaaaaaagcagcggcattctttgcaaaggaaatcgattagaggcttatcgatttgttgacaaatatcatacagagtttggcatccgatggctgcttcggcggttctgcatttgtccaaacgcctactataactaccggaaacaccggaaggcggattactatacccataaggcaaaggttctgaaggccatagacatcatttatcatgatcataagggagttgatggttacaggagcatgcgcgtgtatctggaacagaaaggatactgctacagcctgccgacccttcataaatacatgaattcagaactgggacttaaatctattgtccgccgtaaaaatcctggttatatgcacgggaagccacataaggtatttgaaaataagttaaaacaggacttccatgcagattccatcaatcaaaagtggtgtacggatttcacatacctgtttttgaaaaatggagatatccgctataattgcagtatcattgacctgtatgaccggagcgtggtggccagcatcaccgaccggcgaattacgagcggactggcgatcctgacgcttcaaaaagcgctggattcccaaccggcaatcaaaggcgaactgatcctgcactctgatcagggtagccagtatacctcaaaagcctttatagattattgtgaatccgtccatgtgacgcaaagcatgagtaaggcgggctatccgtatgataatgcgccgatggagaggtatttcaacacgttaaagaatgaatgcaccaatctgtatgagttcaaaacggaagaggcactatatcggaccgtggaagaatttgcgtacgtgacatataaccatgtccgaccgcacagctttaacggatatcgtcccccctgtcaggcaagaaccgcagcataaccagagtataagctcgcgaagaagcagatattttctagccacaagtgttacaaaaaagcttgaccacaacaaaacatcattgattttcccatcctgtcccatgacctgacggtcaggctcgtaagagcctgtggatcgaaacgatgacgcggttcttgctcccgcccccggaattggggtcaggctcgtaagagcctgtggatcgaaactggccgaattttccgttcgaagagatgggggaggggtcaggctcgtaagagcctgtggatcgaaactacttgtgatgttggtattaatggcccagctggggtcaggctcgtaagagcctgtggatcgaaaccgtaaaggctattcctacaccttgtacggaaagaggtcaggctcgtaagagcctgtggatcgaaacggtctgaccgcccgttacacttaagtggcattgggtcaggctcgtaagagcctgtggatcgaaacgttacgtatatagccatatccatagtgctcatacaggtcaggctcgtaagagcctgtggatcgaaaccggcctccgtgcctgtagaatcagcgtttcaaacttggtcaggctcgtaagagcctgtggatcgaaacaatttgagcatttttgaggcgttcgctggccgccggtcaggctcgtaagagcctgtggatcgaaaccggaatcggcacaataactgccagctcggcggcggtcaggctcgtaagagcctgtggatcgaaacactgggtggtataataagtacataaacaagagaggtcaggctcgtaagagcctgtggatcgaaactcgatttccgataatgcagtagcatggttggtttggtcaggctcgtaagagcctgtggatcgaaacatgaattaggtcacgcaattatgcatccaaaagaggtcaggctcgtaagagcctgtggatcgaaacaggtctgcagtaaaaatcataagaacagtgtggaggtcaggctcgtaagagcctgtggatcgaaacggcttctttttcagcttttttataagcttcatcgcggtcaggctcgtaagagcctgtggatcgaaactcccttattttataatttaagccatgaaaaggagaggtcaggctcgtaagagcctgtggatcgaaaccagttcaatcatatccagcatggcatccgggtcacgggtcaggctcgtaagagcctgtggatcgaaaccaactgccttctcaggcccagacaacgccgccttggtcaggctcgtaagagcctgtggatcgaaacccgaaaaatcagaatagtcaagacctaacacaatggtcaggctcgtaagagcctgtggatcgaaacgacacatacatcgcacaccagggctgcgcctggaggtcaggctcgtaagagcctgtggatcgaaacctttctttccttcatattacaaaaaatgtggtgaggtcaggctcgtaagagcctgtggatcgaaacaggtctatgccaataccggtgccggaacttacgggtcaggctcgtaagagcctgtggatcgaaacatttgaaacgatgatacagtttattgcgcaggtaggtcaggctcgtaagagcctgtggatcgaaacattccatgcgtcttcatgaggccagccagatttccgtcaggctcgtaagagcctgtggatcgaaacatccaacggacattgagtaatatccaggataaaatgtcaggctcgtaagagcctgtggatcgaaacttcgattcgcatcccccggtttaaaaggtccgttggtcaggctcgtaagagcctgtggatcgaaacgtgacaattatgtgagtcagggggatgaaggtagctggtcaggctcgtaagagcctgtggatcgaaacatagcggaatcattttgcaaagaggaatatgcttggtcaggctcgtaagagcctgtggatcgaaacatccaaacgacacatttctacaagctggctggaggtcaggctcgtaagagcctgtggatcgaaacctattgcgatttccatcagcccgaacaggatatcggtcaggctcgtaagagcctgtggagcgaaacccgtaaaaagggcaaggtaaaaatatgtgcgccatggtcaggctcgtaagagcctgtggatcgaaacactgtcgattgcatatgccagcacctgagaaactggtcaggctcgtaagagcctgtggatcgaaactaagtttcgcggttggcgagaaattaacggttttgtggtcaggctcgtaagagcctgtggatcgaaacctatcagaggacaaattaatgtcgcgcgctgtcaaggtcaggctcgtaagagcctgtggatcgaaacctgagataataataatagttggtttgggtatcacaggtcaggctcgtaagagcctgtggatcgaaacactgctacagaaatagtgttctcgctactatagggtcaggctcgtaagagcctgtggatcgaaacgccccgttgcgccgaagatggcaggcgagaaagggggtcaggctcgtaagagcctgtggattgaggttttattggcgcaaagagatgtggattccagtgataagagatcggcagatgaaatctgtcagcaggaactgaagaatgctgtctgcatcacacttaaggaaaagggggctcaggaaaaggggagtcttatgaaaaatgtgatccggacgatggggtatgcccgaagcagtacttccttagtggaggctgctgaaaaggggatgaagtatggaaggaagacaggggagattgtgcaggatgaagagaagcggtttaggctgggaaattgacaatcttgctaaactgaaaagtgcagttcgctaaggaagaatgatacccggtgtcagaaaatagtttggagaaactgagtaacaacaacagcaaaaacaatcattcatagcgattaaatcaccagaagaatttacctgcacattaggaaatgattaataaattctttagcattcaataatacaataattcaaaagatttattataatgttagaggagataaaaatcatggaacgtgaagtgtataagccggattgggtatagagttaaggaggcatcatgaaaggatttaaacgacagaatcagttattttctctctgtggattgaattgtggactttgtcccatgtttttgaataaaaactgccccggctgcgggggcggtgaaggaaaccagacatgcaaaattgcaagatgcagcattgagcatgatggagtagaatactgctttcagtgcggtgaatacccttgtgaaaaatatgagcatattgacgattttgattcctttataacgcaccgccaacgaaaggctgatttaaaaaaggccaagctgtcaggagtggaagcttataataaggaacaacaagagaaggtaagaatactggatattctcctgtccggctacaatgacggacggaaaaagacactcttttgtgtagctgtaaatcttttggaattacaagagctgcaagaagtacttagagagattgagaatagacctgacataaagatgctgacactcaaagaaaaaagtgcttttgttgcaggactgcttcaagatacagcatctaatagagggattgatctgaaactgcacaaaaaaaagcggtgataggaagctctcattctttgtcagtgacaaaccaaaataaaaagggattgagaatagcaaaaatgaaaggtaaattcatatgaagtacacgtgtatgcttatatcggtagccgacattaatgccgcaagaaaattttatgaggatttgttcagattggaagtatttcaggattacggaagaaacatcgcttttacctgcggcctggcattgcagcaggattttgactggctggtgaacctgccgaaagaaaaggtattaaagaaatccaacaatgcagaaatcgtctttgaagaacaggattttgatggttttctgaataagttgaaagaatatcctgacatagaatatctgggagaagtgctcgagcatagctggggccagcgggtgattcggttttatgatttagacggacatatcatagaagttggcgaggatatgaaaatggtgataaaacgttttcttgcttccggtatgaatatggaagaaatcgctgtgaaaatggacgcttccgtggaggacttaacgaaacttttgaatcattaaaatgtccattttcctgtaaggttttcatagggatatattatacgtgggaggtgtcggagcaaatgaaacaatatattgcatttttgcgtggtatcaatataagcggcaaaaataaagtgtccatggcagagttaaaagaaggttttgaaaaacttgattttggagatgttaagacatatttgaacagcggaaatgtgattttttcaggtgacgaagatgaggatgaaacgtttacaaatcagattgaggtaatgataaaaaaacggtttggcttggatattcctgtttttgtcatagcaaaagaaaaacttgagaacatcttgcataatgcaccggactggtgggggaacggaaataatgaaatttatgacaatctcattttcattattccgccggccacattcgcagaggtatatagtgagattggagagcctagagcggaattagaaaaaataaaggaatacaaagaagtgatattttggtctttcagccgaaaagattatcaaaaaacaaattggtggtctaagacagcaagtgcagctatcagcagcaaattaacgataagaacggcaaatactgttaaaaagacagttggaatgtaatcgtttttgttataatttgcaggtaggcagaatagcagagcagaaaacaaagaggaaaaatttatgtttgcagatggtcgaagcaaaaaagttgtttttatagcacattgtatattaaatcaaaattcaatatctgacgggacagccgtttttccggcagcttttaaggaggtcataaaaattcttcttgatgctgatattggcattgttcaaatgccatgtcctgaactttgctgtttgggacttaatagaggtaataacaatggcgcagatgatcctgttgtcattgaaaatacccgcattcgtaaggaaatgcaaaaagatgaagctcataaattattaatggcccaagttgattatgtaatgaaacagataacagaatacaatgcctatggctttgagataaccggaatcattggtgcaaatcgttcgccaaattgtggtgtggaaactacatcagattttaataaagagataagcgggaaaggggtatttatgagcgaacttagtaatagaatcaatgcgctcaacttgaatattcccatgttaggaatcaaaaacactgataacatttttaatcaactaaaatctattattaagtaaaaacaaattggaatttatcgggcggaacaacacatcatcaaagagccggatacacgaatgatgagtatatgctatattcaatttgctgcaatgtttcttcttgactttcacgctgcgtcatagtgtatgatgaagaaaaatgaaaggaattaaatatatgagaattgtttctgtccgttcagatggtgtttattcaaaaattatgaacgcaccttttgacaggaaaaatgatatctaccgttatgaactgatgaagccttttgaaaaaaagtgggcttgttacagtgtgccaatgaaagctgcagcacgtaatggctatgatgtcattatggcaagcggaatgcttggacatatggcgccaaccgctgttgatgaaaagcaaaagcataatattgaactgatttcagacaatgcgctttggaaaagatgtgaattgtcaattcaaaactcattacactgctttattgagcatggagtaaaattacctgttcaagagtatatgtttaccattttgcttgcaaatccagaaagcccatacactgtgttaaataatggctattgcggagatggaggtattccgggatatatttttgtttggctaactccaaatgaatatacattaaatcatcttcatgttgctttagcacatgaaacaaaccataatgtgcggtttcaatttatcaagtggaaaaatgacattacactcggtgaaatgatggtcagtgaaggattagctgaaaactttgcaactcaaatgtatggtgaggataaagcggggccttgggttactaaaaccgatatggtaaccttaaatgagtatattaagccaatcattcacgatggtttaaatgttcaagggcttgaaaacctcaatgcctatttgtatggcgatgaaatggctgctttgcaaaattatgctcctgttggtttaccttactgcgcaggctatgcttgtggctatcatttggttaagcattatttgaacaaaacagggaaaagcattgcagaagcgactatattacctgcgagtgaaatcttagattgtgtggaggacttttggaaccaataaaatataatttggagttttacaacaagcatgcgaattccactggcggttttgaatttaggctctttgtcaatagttggggtgggatttgttaaaatcccgccccaattctatgaaaagggccctttttatgtttagttccaggttttactgattttgggcatgccaaataagcctccgcattaccgacctttttatcctatgatgtacagtgaagtatccgggttcggaaccgtttgaaattccggattccgtagctgctccgttttaatacctttatcttgttgttaaatccttctgtgggaccatttgtcagcccgtatttaaaggcattcaggatttcttttcgccaggccctgtaggtcttagcacaggcctcaaattccttgatcccacagctctgcgcattcgcaatccagtcatcaaattccctctgctgctgacgatacgcttccatctggcagatatcatagaaccactctttcatgcggtgtgccagacgcagctcctcgctatagtgaagcattaaatcacaggcctgtttgttctcatccttcagctttttgtagcgggtcagaatgagtttccggctgcgtttataatacttacgcagagaaaccggcatggagcgctgcagccgtttgcgtacattttcaatcgcccatgtcacctgccggatgaaatgatatttatccacgatgattgtagcgtttggaaagaaggtttgtgcaagttcggtgtaggggcgccacatatcgcagacgaagaactttaccttcaggcgttctttcctgggaatgttccgccaataatcagccagatggctctgggtccgatctgggagaatgtcgaggatccggcgctttttcggatcaagcagaatgcactgatatttaccggtagaagcattgcctttgaattcgtcaatggaaagcgcttgtggaagctggtcaggcggaggatagcaaatcgtgtccagaaggcggcagaccgtctggacggaaacaccggtaagctctgcgctctgttttaaggaaaaggtctgccggagcagggagacaatgtaaaatgccagcctgcgggtcctgcggtggtagctggggaggaacgaatagggttccgtgaaccgtttgcggcagtatgggcagaggtagcggcgtttgcgaagaagcaggattacttgttttcccagtaagggaatgtcctggacttcttgtaaacggtaatcatgaatccgttttgttttagccccacagcagggacaagtctgttctaccggttgggactggatgaaaattttaatgaaagagtctgcctgaaccacttttttaatagaaacaccttccaagttaaggaaagccttggtataattagggtacatctataaggggtcacctccataacattaaactttggtcgggataatgcgtttaggaggcttcttatagatgtattttattacaacgaaaagaatgttggaagtgtgcttttcagcacaccccaacattcagtatagaacctgaatttattttcaggccgcctttttctttttataaactaaggctccagccaaacagttcgggctttaatatcacatttctccaacataattataattatgtgtatcttaggaaataattaatcatttatccattatatataaacacattagtgtcacggatccggtataatgtatatgatttaatctgaaaggagtgtcatgctttgcttgaaaaaatacttgttgttgatgatgagaaagaaattgcggatctgatcgaagtatatcttcaaaatgaaaatatggatgtatataagttttattcaggggaggaagcgcttgtctgtattgggagtacagactttgacttggctatattggatattatgcttccggatatcagcggactttcgatatgtcagtccatccgaagtaaggagtacacatatccggtaatcatgcttacggctaaggatggagagacggataaaattaccgggcttacactcggtgcagatgattatattacaaaaccgttcctgccccttgagctggtagcaagggtaaaggcccagctacgccgttacaagaaatacaatgcgggctcagcggttccggcagcagatgaaatcttcaaatatgccggtttgacgatgaacattaagacatatgaatgccggcttaatggagagacgctgtcactgacccctacggagttttccatactaagaattcttttagagcgcaagtgcagtgtcgtcagtgccgaagaattattccatgaagtctggcaggaagaatattataccaagagtaacaatacaattaccgtacacatccgccatcttcgtgagaagatgaaggataccggggaaaatcccagatatataaaaacggtttggggggttggatataaaattggggaaatttaaaaaaacaaaatacaactattcaaagctcggccgtattacatttatcagaggattatggattacagtgggagcagttgctacagtctttgccctgcggatgctgacgcgtggacacttggcagacgcgattgtcgggacagttgcacgcagtctttcaatcagtgagaaggaagctgatttgatatatttcaagctagtgactgtcaatatgcagtttattcttgcgttggtcataatcatatttgtttttttgttgttccacatgcttttggacacatataaaagatattttgatgaggtagtaacagggattgacaagcttatggaggaaagggcagcgatttccctgtctccggaactggagagtgtggagcataaactggccgatgttaagcggacacttgcagaacgggcggataaggctaagagggcagagcagcagaagaatgatctggtggtatatctggcccatgatatcaagaccccactgacatctgtgataggatatctcagccttttagatgaaacaccggatatgcccgatgaggagaaagcaaaatatatccatactgcatgggaaaaggcgaaccggctcaggaccctggtgaatgagttttttgagattacccgcagccattcagaatctcttccgcttcataagacaaaggctgatcttttttatatgattgctcagatttcagatgagttgtatccgcagttgaatgcatgcggaaaaatcatagagaatcatgtggatgaggacatatctgtgtatggagactctgataagctggccagagtgtttaataatatcctgaaaaatgccatttcttatagtgcggaaaacagcgttatcaaagtctcagccagagagctttcagaatggacggtgattcaatttgaaaatgatggggaaattccggaggataagctcaatgtgatttttgataaattctgccgtttaagcaatgcgagattaagcgaaacaggaggctccggcctggggcttgctattgcaaaaaatattattgtactgcatggcggacagataagggctgaaagcagtaatggacgcactgctttcatcattgaaatcccatcagcatcatccaaaatctctgtcacagcatcttagcgattttaatacatctaccatttcgatcgacctgatagaacaggcggggaatcagacgattatataatacattaaaaaggtggtgagcattttgaaaattcgcagtgaatttacatgtccgttagaattggttcacgatatggtaaagggtaaatggaaacttattataatttttaatttgaggaaaggctcttgctcattttctgatttgttacatagcattgatggaataagtcaaaaaatgcttttggagcaactgaaagaattaaaacagtttggcttagtcgggaaaaaatcctacgctggttatcctctcaaagtagaatattttctaaccgatatgggtttaaaaatgctatcagcgattgagataatgcaggggattggtatagagtatatggtaaaacacggaatgtcagaaattcttgatgaaaaaggaatttgttattgacgctatgcacgaaaaagtaagtaatttacttgctggcggctttcatgtattattttatcaaatagaaatgtagaagggatttgataaaatggatactgcattagtaataattgacgttcaaaatgactattttccacaagggaaatgtgagctttttcaatcagaacaggcattaaaggtcacaaaaagactgctggaacattttagagaaaggaaactcccgattttttatgtacaacacatatcaccagaggacgcagctttttttctcccaaacacgaaaggcgttcaacttcataaggagatagaacctttaggttcagaatatattattgtaaagcatacgcctaatggcttccatgaaacaacattgcaagaaaaattaacctcattgtcaataaaaaatttggtaatgtgtggaatgatgacacatatgtgtgtagatacgactgtgagagcagcaaaagaccttggttatttggttactcttatatctgacgcttgtgcaacaaaagacttagaatggaacggtcgaaagctgcctgcaagttttatcaatgatgtatatatggcttcactgaatggtagatttgcaacggttatgtcaagtacagattatttgctgtaaatgtcaagtcaactcagactgttacggcaggggcgaaaagacgttatataatagggcttttcgggcacggaaatcaagcggcaagattgtacttttccctcataaacagcgtcctatcgcgtacatggccacagcacccgcaacaagaccgggtgctgtggcccatgtacagctgactaatctccatcattatgtggatgctttttgggattctttttatcattgtattttttcataataaccatttttagtaagccaacgacaatcaaaaccgcggcaatgataatccaccagtattgctccataacctacttcaccccctttcagttgtcttaaatcatctgccccgtcctatgcagaatggagaagttcattatcctgccagcttctgaaacagacgttttgtaaggaaataataccagattaaagctgccgccaaagccatgggaaaataaagaaccgcctcattctgtacggctttggctgcccaaaatgatggaaggaagccaaccgcaaactggcagtaactatcaatcaagaatggggctggtattcctagtaatgtaagtgcagccagttttgtaactgccattccctccagtttattagctgaaagggtaatgatcatcagggctaccataatagcctggaccgcccctaaaacggacaagcctaaaaccatgatgacggaccgtttttccaatgaaaagattaacatcacaataaatgtaacaaccgttgacagaattgcaggtattccaagccttgaaaaaatatatcctgattttccaagcggagttattgaaaaatacctggaaactttatcatcaatttcttctaaggtaatcatggcaaaagcaaaacaaagaagcactggcgccatgatagaaaggaataagtcaaacatcggataatagggctgtaaagaaaattttgccgctttttctatcaatgggattccaaatttaataagggcgccaaccagaaacggggtgaaacaagctgcaagcatcatgggatccttttttatctgttggaatacctgccctatgctgttaaatacctttttcatatcttcacacctccaatactccgccacatttttgataccattttatgtgttgccggatataatacaaaatttgctgcaagaaccagaaccaaatccaaaaacgggttctggctgtaccctgttattaaattcatgcaggccataaatggaaagaaccgtaaaatttccggcaggtctgtaaataatcctgcaatggggggaacaaagcataaaatctcaatgggcataattacaattaaaaactgattcaggttcgcaatcttcgtggcagccatgatgccgagcatagtaaaaattgatgatgttaatgctgtcccgattatgatacctgataggttcctatttccagcagcaattcccagtatcaatgcgactacacaggatataaacatcagtgaaaataccttggccaggatgtactcggatacttttgccggcgatatggcaatcgcatggagtaccttttgacttttttcaagtaaaacaatcgctcccatgaagaacagccccattgccgccggatcggaataaatcataatggcggctgcattgtgtttccagttatccggtaaagctgtaatgccgaagacataaatcacggtcaaaacaaaataaataaagtaaaagccatatttccattggaagtgaatatcgccgcagactaatcttcttaatttcattgcagcgtcctccctgttatatccacgaaaatatcatttaatgtcggttcactgctgtggacagagcgaagactattgcttcggataagttcatttagccgtttatcatacgcagtttgtgtaagcgtgcattcacccgtcttttctccattttcaaaataagagtaccggattttagcggcgcctcttgacatgataagattgtgtggggtatccagggcgctgacctttcctgatacaataaaagcaacctgatcgcacagttcagttgcgtcgaacatattgtgcgtggtaataataatcgtcttcccgcgttttttctcggcaaggataatatctttcatgagcctgctgttggtaggatcaaggccgctggtgggttcatcaagaaaaagaatatccggattgtggaccagggcttttataaagttcagcctggaacgcataccttttgaataatcggaaacctttttatcaccgtcattttccagccccaccatttttaaaagttcttcagtggaacggagcggccggtcatacagggaaccaaagtatttcagattttcgcgtgcggtgaatttctcataacaggtggaaaactcaaaatcaacgccgatacgctcgtaaaatctgttagtcctttcgcggatttccgttccagctactttgacactccctttatatcttgtgttaagaccggtcaggactttctgtatggttgatttaccggcgcctgagggccccagaaaaccgaagatttccccccgtcctacgtgaaaactcacattttcgacaaaaggcttgtttgtgtagctgaaacataacttgttgacttcaatcatttttacttcctcctttttgaatatatgacgttttataaaatatagtcatattaagaataaaaaaagtttggctacctgtcagccaaataaccaaacaagtgctgctatttcttaacaacctgttccacgataccatcaactaaaagtgtttgtatctgttctaattcttcatcttccctgaactgctccaggcaggtcaacacagaatatagagatttaatcaatacagtatgaggaacggtaaactgtactcccatttgctgcaacatttccaatatgcggatatcattgtacatatggttactgaaaatatcaggggacaacttccgctgcagataatccattatggataaatcaatctgcgacaggatgggagaagtaatgattccggtaagactcatcataatgacgtctttggttaaagccttttgcgtaggataatgcttcttcttcaccactgtttcaatattttcaaaaagtttctgctgtaattgaaagttgatttcgatatacaggtgttccttgctgggataaaacgcataaaaggagcctttggaaatattggcggcaacagctaaatcatcaacagtcactttctttaatccatgcagggaaaaaagtttttcgccttcggccagtagtttatcactaataaatgctttctctttttcagtaaagcgtggcacttttatcacctcctaatgactaaatatttaatatagtcatatagaatataccacgtatggcccgcaatgtcaattattatctaaagtaattaaaaaaatgccgcagtgccctagagcgtgtttgaaaattcattcccgccatctgcacgccccacttcgcgggagatttggcccgaattcgcttgccgtagcccactacgccgcgctcattcggaccaaatctcccacaaagtgtgacgtacatctgacggaaagcaattttcaaacacgctctagcgatttcctgaaaaaaagcgcattgtgtgataagctaggcaaaaaataagatgatataatgtgaacatcaaatacaggaggtacaacaatgtacgcatgggaagcaattgaacaatccttaacatttatcgaggaacacttaacagaagaaatttatacggaggaactggcaaatatcgccggcctgtcccctttctattttcagcgtttgttcaagcggctggtaaataaaccggttcaggaatatgtgaagctccgccgcctggcaaaggtgattgaaaatctgggtaataccaaacagagaatactggacgttgccctggactatggctttacaagccatgcaaattttacgcgggccttcaaggaaacgtatggaatcacacccgaagagtacaggagagatttaccaatgctcaacacattcgacaagccggaagtttccatgaattacgtcttagtagatgaaggggttccgctggtggtaggaaatatcgtcttggaaatccagagaaaaacgttggcggaaccggaagtttacctcggctttgaaacaaaagtccgtatttctgaacagattccggctggtgaaagcacaggtgtagatgtgccgggacagctctggaaacgctaccatatggagaagacgtcaatcgcagcagacatcgatacaaatgtggaaatgggaatgtcccatacggaaaatacggcacagggccttttcacgtattttgcgggcggtcttgttcgagatatcccgcataatcagcagggagactttgtaaagagagaactcccggcgggagaatacatcgtttgtaggattgaagcagaaaattttgaggatttggtaacggttgccttgaatcagggtggaaaataccttttcggtacatggctgccgcatcacagtttaacaacggagcctttttcagcagaaaagtattatcgtgacctaaaagatatggcctgtatggaaatttgggtcaagcccataccgttggaaaaaaaagagtaggagggatattgggatggattggaatatgctttatacaaacggcgatgctccatctctgaagcaaatagcggagtatattgacaatccgttatgggcagagtttgacagccgtatccggtccgcttaccggattgagccttatatggattacagccgctgttccatgcagccaggctggaatattaaatacaagaaaagcgggaaatctctttgtacctgttacccaatgcagggttattttatcgctcttgtggtgataggaagccgtgaacttacggaggcagaattattaatgccgttattttctgactatgtgcagaaagtattcagagatgcaaaaactggtaacggacagaaatggctgatgttagaagtacgggataaggagattatggataatgtttttgaactgataaatcttagaaagaggaggatatcgccttaggaatttcttaatcattcatttaccattccatagaaaatcaattatctcaaattaaaaaactgcctgctcatcaatggtatgcttaaactgcctgattgagcaggcaatatttatatgaaagcctgctaataaaaagtcaagcactttttgaaaatttttgtgaagtgattttatggcacaactctaagaccgcctcatcagccggtcaaaaagaaagccgtaatagacggaatgattattcgttttgttccagactgcgcagatgtgcttttaccttgccgtagtagatgcggaggaacttattcgcaccagcagtcatgtacacatagtaaggttttccttcggaacgcttccggttcagaaactggtagacaggttcattctccggggcattctggagcagggtggtcatgacctggaacagggtcttacggagcctgccggttccacatttggaagctttgttgctctttgagttgtgctgccctgactgctccacaccgggatcgacacctgcaaaagcagtgattgcctcccgatgggtaaatcttgaaacatcgccaatctcagcaatgagctggggaccgtaagttttgcccacgccatacatgcccatgacaacctcgtattctgggagcgtggaagcaagtgcattcatctccctgcggagctgttcgatatgggcagaggcaagattgagctgctggatactctgctggatcagaagcttataggacgtctcctttgggaacacggcaacaagctctttagaggcgttaaacagttcttctggtttggaaggctgataaatataatggtgtttcctgcagaaagcttcatagcgcactgtaaaagctttcaagccggttttacggacacagtccacatgccagaatgagtaagcgtaatcgacccatttttcactgccatcttcacgggcagggctgttgaacagtttatttacaccggggtatgtattatccaacagtgcaatcaggtttgcctttgcggcaaccttttgcttcataaagaagctgaattgtgaatttaaggttttcaattggttacgtgtattgtccatacatgaatactgccgcagttcagcccagttgtcaagggtatagcgtgctatctttttagcatcagcagggtcagatttgaccttgcgcaacgtattgttaccaaagtttttaatcagatgcggattgacgacagttacaaaaaacccggcattagagagggagttagccatggactcatggtatctgccagtacactccattacaatccttgtatccccttcaagtgaagccagataatttgatagttcttttaaggattgggaagtgtgaaaaacatcaaagggtttcctgacaatgacgcctccgggctgcaggactgcgatggtgctcttgccctttgagacatcaataccgacagcgttgtacatcctaatgtacctcctgaaaatgaatttgcatggtatccagcattcctcactgcttattcaatctcctggggtatcaaacggacatgtacaaggacagtccaacctgcataaatcgaacggctgcaaatgataggctggctgactggctttcttgcggacacctaaagtggtcctaggaggtgtcgtcataccaatgcctaatcattatacagcttaaacaatgagaggattaagtcccaactggctgttgggtactgaaaccctacacttatatattaggaggaggtaattttagagtatggaggtggctgtgagaaagaagttaagacggatttttacaatactgggaacaacagcaatgatttttaccatgacagcctgcgggaaccgcatggatgccatgcagccggaagcttcctttgttgcagacttttttgatattccggacacagtgacaggaatcgaaagacttctgctcaaagatgatatggcctatatgtgctgcctggaggaagatggcacgacctatttggcatcaatgaacattgatgacggcaaatttttgaaacagaatctggagctggatgcctctgtttcgcttctggattttggctttgccccggataacagcatctgggcggtttgcctggagcaggccggcgtctatagtttaaggaaatttgacaacaaaggttcacaggttcagtcggttgacctggcaggtgtgatggacaccccggtcatatcagcagttggaaaagatttgttcctcagcattgatagagagggaaatatctgtgtggctgctaaaggcagaaatacgttggtctatctgttcgacaataacggcagtttcttattttctctcgactatgagggaaatcttataacgaccacaacgactgccgggggacagattggtatttgtgcgacttcctcggaccgtatgaactatgacctgatgacagtggatatgaagagccgggattggagtaaagataaaatctatctgggcgcaacagcagggctgtacggaggtgtgaacaaagatttctatcggtttgattcttcggttttatatgggtatgcagcgggcgcgcaggagggcagcccggtctttaactggtcggatatgggacttggcacatcagaggttcatcttggagaatgcacggacgggcgttttgtggtcctggcagcctcatctaatcagactgaggtattatcgtatgaaatggcggtgctgaccaagggggtggatgagagggagattttgagtatggtgagcctgagcgcgatccccggccttgtccaggccgtatctgattttaacaaaacaaacgacaggtataaggttgagctgacagagtattttccgtatgcgcagaatgtgactgacgaggaatgggataatgccattttaaatcttaatacacggatcatctccggcgatatgccggatatcctggatatgagtaatttgtcagtacagatttatcaaagcaaagggcttttagaagatctctatccatatatggaacatgatccggaaatcaggaaagaggattactttgaaaatgtctttgaagctatcagcctggatggaaagctgccctatcttacggacggagcagccatatccactatgctggccagtgaagatattgtggctggaaacgatggctggaccattcaggagctggaaaaggtccttgatacttacggagccaattccataaacaatctgtctggtgcttccttcctgaaaatcatgcttcagacagatggcagttttattgactggaatttgggcaaatgctcttttgattcacctgaatttgtaaaaatgctggaatttgccggtaaaatacaggaaagcatccagaatggctttggaggaatggagatgagcgaaagctatgcagcagcctatgagactgtgctgagcgtttaccacatcacccggtacagaaattactacaacgggaacctgagatttcttggacttcccggaggaggcggtgagtaccacgtaatcaaaccggaagtgaaggttggaatctcctcgtccagcccccggaaggaaggagcatgggaatttgtcagaacactattgacagaggagcatcagatgtcctgtatgatgcttccgattcataagagggcgtttgataaggtcacgcaggcggcggtggatggaaaatctgtctggacgtggatttacgaagacggcaaggcaacaaaagaagatgtggagctgacaaagcagcttttaaacagcgcagcctatgtggagaatgacaatcagacactggaatcactgatattggaggaggccagggaatatttttcaggggccaggagcgccctggaagcggctgaaagaattcagagccgggccagtctttatatcaatgaacaaatgtaaaaattttatatgcaaaggaaaggatccaaaactatgaaaagacagcttatgaaaagaggaatgatggggatatatgcagctatctgcgcggggatgcttttggttaccggctgtgcaggtacagagacaaatgcaaaaacggaaacagaaagaattgaagcgacagagagacaggaaagtaatcctgtaaatactgccggtaaggaggagaaggaggaagtccctgaaaagcaggaggaagcggtccaaaatgattcgcctctgcaaagtcaggatgatgccgggaacggggattcagatacaatggatacgtttgcagatgcgaatgacatgatgaagtctgctgatttgagcggcacagccggcgaatgctcgaataccgggtgcgtgattaatacatcaccctttgcggacggcacttcatcttcaggagatggaggcagcatgacggttacttattcagaagacacagtatttcaaaagggaaccgtgaaatcggatggcagcagctactctttggaggacagtgaaaaagacaggataggggacagtgattttgtactgtgttttgggaaacagcaggcggacggttcttacctggcagacagaatcattatgattgtgttcaattaacctgataggagatgatacagctatgcgtttacatattggggaaaaaataagagaacaaaaggccatgcttatttccggaaagaaatacaggcccctcatagaagaccgtgtgcagcgcatggctgtatatcttatgattggattttttgcattcatgttagtatgcacaattatttcccgtgtatctcattcttttactaccgcccatgtttcggtagcttcgatgacaggcaaaacgctgatgaacagggctgaaatggaagggattatctatgcgtcagcggagaaagggattagtcttccggatggccttaaggccgtttccgtcaatgcagggaagggcaaatcagtagaaaaaggcgaagcgctgatagaatttgatgtccctgccgcagaagaacggattaaaaaactggaagaagaaatccgtatccttaatcttaaattggatatttcatcaaacaatggcggcaatgatgtgattgaggcacagcgtacgctggaggatgccaaaaaggcgtatgagcggattgctgcgaagtatgccaggacagagatgcggctgaaagaagattatacaaaacttgaagaaacactggcagatgcggaaaagaatcttattaataaggcagaagcgcttgtgaaggaagcgagggaaaacctgcaaaatgtaagggaggacgcggaggacgccatccgtgccgcagaacaggcgctggatgaggaatcagaaaatcttgatgattcagaggatagttatcagcaggcattagaagcgtatgagcaggcgaaagatgaacttaatatggcaaatcagagagtcagcgaaataaaggaagcgattgcagggaagcagccggatgatgccacggattatacggaggagctgaaggaggcggaggaggaactttccattgcgcaaaaggcatttaaccaggccaaaaaggaactttcaaaagcagactataactcatcgtcctatgacagggcagacgataacctggattccatcaagcgaggctggaaacgtaaaattgataaagccaaagatgctctttataaagcagagacagtgctggaagcagtcagggaaggaaaagatttttcaactgagtctgcagtcagtgaggcccaggctgccattgatactgcaagagaagcgttaaaccgtgcccggcgtgagtcagaggataaccaatattctgaggaggaagaactttatgctgcgggaagggcagttgagaccgcgcaggcagcattggaagatgcccggagacaggctgaggtattgcagaaggaaggtgagattgacagaattacctgtgaatctgagcggtcagataaagagaaatcgcgtgctgcattacaggaaattctggataatgggggacgccttttggctccggcccctggaacggtggtgaggacgctggaacgcggggataaaacaaaggagggggaagatgcagtcattctttcctctgctgacagaggatttgtttttgaaggaaaactggataaagattcagcgcgccgcttttcagccggggacaaaggagagcttcattacaaattggatggaagcacacaaaaagcagatgtggagattcattccatcagcacgccggacgagttggaccaggttttagtaactgcggttctgccggagggaggttatacttccggtatgccggcacagctttttctaagcagaaagagcgagacgtaccaaaattgtctgcctcttaccgcactcagaagtgattccggcggagaccacgtattcgtactccgcagacaaagctccgtactgggaacagaatgggtcattgcaagggtagatataacagtaaaggaaagagacagtcagatgatgtatgttgacggcgcgcttacgtattcggatcaggtagttataagctcaaataagatcatatcggaaggagacagggtccgcattgaaaattaacaggtttgctcattaccgggcgttgataatatcagcaatactggcagcagttctttggagtttcgcttgttctttctatagtacggccatcagtcactgcaccagtgttggaattaaatgggaaaagggcggtgtcagcccctcagagcttatcaggcagcagacgtatgcaaggcaggatggagcaggaaaccagccggaggtcaccttatggcagatatatccggaacaggagataatggcttcagataaaaaggagatgaaggcggatatagttgccgcctttggagactgcggggatgttgtctcctccatgccggctgacggagcttatccggccagatcggatgcctctggctgtgccgtcagtaccggtctggcattctccctgtgggggagtattaatgtgattgggttgccggtaaaggcggaaggaaagcagttctatgtccgcggcatatttgaggaggaagaaccaaggttattcttacaggcgcaggcggaatcgaaagaacccttatccaatatgcagctgacgtttacaggtccgggagcaggggagagggccggtcagtatctctcatcggcaggttttccggagggacggatccttgacctgacattatttgcatgggtacttgacatgatactccggctccctgcgatcattctggcaattggtatccttgggcgcgtgaccaggcatgggaaaaggctttgccgttatcccctactgctggctgtttattttttaatcgctttcggtatattggccgtattatggttttgtatggatctgcctgagtttccttccgagtttgtccccacaatgtggtctgattttgagttctggggaaatctgtttcaggagcaggggaaaaatatggtctcctggatggcggccgggcctgccttccgggatatggagctttggacctcgtcatttatggcagtgctgctttctgtgtgtgcctctgcctttacggcagccgcagcaatgctggtatccatacgctcttacaaaagaatgatgttctattgtgcggcatatacactgacactttgcctgatttcattcaagatagcctctgctcacaatatgaccttttgcaaagcgatgcatcttctgccatgtctttggatatgtgtggattttctcttttactgtctgaaagaaacacttgccgccgatgtccgtgaagggaggattatggatgaagaaaaaacgtgaatacagtgttccgatccgggaacaaatggtaccatggctgtttttgctgccgagcctgctgttcgtgagcattatggtgctgattcctatgctggacgctctgcgccgttcctttttcctggctgccggtgaccggtttgtgggatttcaaaattatctgtcagtcttgaggaaccatgcgtttcagctggcggcagctaatacagccaaatttatcttagtctgcataccgcttctgttactcttttccctggctgtttccctgatgctggcctccttcagggaaaagcgcggcattttcaagacctcgtttcttgtacccatggcggttcccgttgcttcgattgttcttttgtggcgtgtgatttttcataaaaatggacttctcaatgcatttactgcactttggggtttggttccggttgactggattggaagtaaggccgcctttggcgtgttggtgtttgcttatctgtggaagaatttcggatatgatatggtgctgtggctgtcaggactcagcgccataaatccggcattatatgaggcggctcagatagacggcgccggaagcctccagcggtttgtgaggattacgcttcccaatcttatgcccacattatttaccattaccgtgctgtcgctgctcaattcctttaaggtgttcagggaggcttatctgattgcgggaggttatccggatgacagtatttacatgcttcagcacttattcaataactggtacggcaatctggatgtggataaaatgtgtgccggagctgtgatgatggcaattctggtatttattttaatactactgctgcaaaaaattatgaacagaggagataggatatgaaaaaatggcttcttggcttgccccttgtattgatttcggtctttatatggctgcctctttggatgctgatatccggtacctttatgggaggggcagagctgtctgaaaatcttgcgcctgtcctggagggcaggggaggaacggctgtatggcctgtaatggcgcgttatccgactctggcggcatatgtggaactattattggatacgccccagttttttacggtattctggaattcctgcaggcaggtttttccaatcatactcggccatgtccttttgggcgcacctgcggcatgggcatttgcaaagtttcattttcgcgggaaaaagatactctataccttgtatattgtcctgatgctgatgccatttcaggtgaccatggtttccagctatcttgttctgaacaaactgggcctgattgataccgtgtgggcagtcatactgcccggtgcggcatcaacgcttccggtattcatcatgacacgttttttcatggacataccggaggcggtcatggaggcggcagccgtggatggggcttcctcatttcagacttttttacgatttgggcttccgctgggagcgccgggcattctctcggctgtggtattgggcttcttggaatactggaacgcaatagaagcgcctcaggcattcttaaaaaaccaggcgctctggccgctgtcattatatatgtcaaacatcacggcggataacgccggggtatcattaattgcgtcactgattacactgatgcctcctcttttgatattcctgtccgggcagaaatatctggagcagggcattatatcttccggaatgaaagattaacggtagtgtcaagtgatttatgaaaaccgatggccggggaacccggcgtaaatgaaccttgtaaattacagatatatttagaaactggcagtgtccgccacccttgacggcacaccaaaacaatgctctgaacgtcttaccgacggcgaagaactcaggaacagataagatttcaccgtctgcgtcacagcatgatagcattgttttggcgtgccatcaagggcaggtcccttcgggatggctgcatttttacctctggcccggaatctaagaacagatttaaccggcagcctgctgttccttcagctggaggatggtctgctgaccgagcagaatcaggagctgccacttcccgggcatgttgtcagccccctccagcataccgactggattgagcacccgatagtggttgtgcttatggggacggagaaagttgtagtaggcgacccagagcgccacgttatagttggcgccattgtaattgtcgtaaccgcagctgacccggtaagtggatttaaacgtgcggttaagccgttcgatcatctgcttgtaggggcggaactccttagagaccgcatcattgtttgtgagtccgattacctgggtaatgtcaaactggaagctgtctcccaactcccttacgaactgctgggcggccagaggataagcactatagccgtcggcaatgaaccgaaacttctcggggagtctttttatgccccggaaagccatgcgcatggcgaggatgcatggcccgacagagcggttgtctgaaacctggtagccgaggatggagcgggaagcggcatccatgatgaaccagatgtagcctttgatgccccggactttgatataagtctcatctgccgtaaagacggaggactttggatattcatagtggtcaacaaagggtttaatgacaatggcggccgttctggcatagttggcgacctgctgatgtgagatcctgattccgtaaaggtcatacagagcctgagccgttttacggagggaaagctggaggttcacatgcatggtgaggcacagggacatgatatgagcgttatgtttggaaaacttcagggaggaggaattctcaggcagggagtctaagtccatgcggaagaaatccaccgtgaattcccggtagaggtagtgcagcttatacttgtttttaccgtaatcctcatgcagatggtccttatcaaccctggagaggttgtgaaggtagaaggagcacctggggttgacgcatttatggatgcggaaaaacttccggtccttattagggacgagggagtggccgcagtaagggcatacaaagcggagaggcgatgtgacaacctcgccggtgacaaaggtctgcccacagactttgcattggaactgcccattgccgccattattatcgtagagatagtggtgaggtgccccacaaagaggacagaaggtatcttcagggatggatttaccattgcggcgctgaacgggtctgacggatttgccgtacttccagagatagtattcaaggagaaactgccagtcctgtttgatgaacggcttgaggagcgggagggggtcggtagtaaacttctggtatttaggggagtgggaaccatcaaaggcccactgcttgagtggaatatatttgcagataaagttcaggagccagcagatagttttgtattgttcttgaattatagtgagtaaatagagtataatgttatccataagcaatgatttatcctttttaggtgatggtttgtggtgaactcattataccagaaaaggggaggtcattgcttttttattttcaaaagtggtgtaatccctgaaaatacaaggtttttaataaaaaacggagtgtcagacttgacactaccagattaacacaggggattaatatatggaaaacaggaatttcgcaggcgatctgcagataagcaaagtgaataaatggtatccgggcgatgttcatgctgttaaggatatggatatggaaataaagagaggggaatttatagtatttgtaggcccttccggctgcggaaagacaacgctgctgcgcatgattgcaggacttgagagtataagcagcggcgaggtcattatggacggcaggactgtgaaccaggttccgccaaagaaccgcgatattgccatggtattccaaaattacgccctttatcccaatatgaaagtaaaagataatattgcttttccccttaaaatgcagcatatcggcaaaacggaaagggagaaaagggtagcagaagtggcccaaaagctggagctggatgctctgcttgaaaggaaaccgggagccctgtccggcggtcagcgccagcgtgttgcccttgcgcgggccatgataagaaaacccggactctttctcatggatgagccgttagccaatctcgatgcgaagctccgcacagaaatgcgccgggagattataacgctccaacgggagctgggggtaactaccatatatgttacccatgatcagacggaggcaatgacgatggggacgcgcatcgccgtaataaatggcggtgtcttacagcagtttggaacaccgcaggaaatatatagaaatccggcgaatctgtttgttgcagggttcataggatcacccaatatgaatgtgtgggacacagagcttatttcaaataacggacaacattatctgaccctgggaaatgcccgtattccggtggataaaagcagtttggccgcaagaggactgcaggggcccattaaggccggtatccgtccggaacacattgtgccggctgcatcggacgagcctcatgcagtgcggatgaaaatcagcattttagaaaataccgggcgtgaagtggcagtttttctcaccgggtctgacataccggatattacgatggtaacaggcgcggatttctcaggccaggccgggcaggaggtatatattcggttaaagccggaaaagatacacctatttagaacagagacaggatgtgcatatggagatgtttatgtatagaatatattcaacagggatagaaactgcggcggcatcaacgatactgataccgattctttttctatatcaaatatttattttccacaacataaaaaagacggctgcctattttatttttatgttatatttgactgcaatgtgctttttggtggggtttcccagtgtggcagggattaaaatcgcttggtcttataattttattcctttgtatggtatgctgaccgatataacgaacagctatctgaatgttttgctttttatcccattaggtatatttgttccatgcttatggcccgaatacagaagcatgatgaaaacagtgggcttgggcctgatgacatcactgggtattgaaatactgcagatatttaccttccgcgcaaccgatatcaatgacctgataacgaacgcggcaggtacattggctggttatctgattggcagagtgatgataaaaatgattcctcaattagatagactgaattgcaggagaagtgagttatatctcctatacggaacggttggtgcagtgatgtttttctttcagccatttatttttttattatcagaggccttatatccgtaaaggctggcatccattcctttcttttgttatgaggaacgagtgtgcttttatcagcccccgccttcaaccccatgaaatcgcagaaaattccgtgccgcatgggacagcgggtactctttattgacaatgaaagcgctcgtgataaacagattttcatcggaaaaatgcttcacggttaagtccctgatatgttggaagtctgcggccgtcagtgaggccagtgcgacggttttaaaggatctggcccactcaatcgcagttgcattcgaagaggtaataatagaaatattcggcgcgagcagatggtggccgaaggaggaacggaccagatccaggcagtcgaagggaaccgcaagcggatagtctgccagcagggatatgtcgataatgctgccgctttgcatcagagggtgttccggcctgcagattgccacaatctcttctttctcatagggatagacagccagggaagcatagccgggaaggctggaccgtatgagtccgatttccgttacatggttcaggacgttcggaatcgcaaaatcacttggtatttcataaaaatcaaaattgacattcgggtatgcggcccggaaatcgtcaaacagatggtgcagaaaataggcggagtttcctgccgggattgagagctttaaaagctcggaaaaacctgtttttttattgtgaatctcgtcttgaagtttttcttcggcctggcagatctccttggcgcgcagataaaaaacgcgtccggcgtcggtcagctcaagcctgtgccggtttcggattaaaagctttgccccataataagtttcaatatttttcaactggttgctcagagaaggctgggcgatcagcagcttgttcgacgcagccagaatacttccgctttctacaatcgcaacaaaattccgataagactctaatgtcatagagcaattccccttaatttataatttaatattcttctaatataagaaaaatattataaataatatgtaataatgatagttttattatataaaaaattatgttacaatgcaaattgtttttaaaaaatagtgcttataaaaagagaactatatataagtataactaatgaataaagataagggggaataaagagtacgatgaatgctttactgacagatttattggccgtatttggagttgttttaaatgcgctgcctcagggacttttagcgctgtcctttggttttgcagccgtcccgacggcgatggcgttttttatcggagcgtttggaaatgtgattacggggaatgtggcgccgatttcatttcaggctgaaactattacatatgcgggtaccagcggcaggaaccgctcggagcggtgtacaatgatctttatcggagccgccattcttgcggttatcggagcctgcgggatgctgactaagattgtggattttatcggtacagacattgcaaacggcatgatggccggtgtgggactgatattgacgaatgcggctgtcaacatggtgaaggaggatcaccttgcaggcggagtatcgatagctgcggcagtgctcacctattttctgaccagctccagtcccaatacgctggtttacacgatcgtgatatcggtcattgcgtccagtgtggtatcggcggttttgaataaagaaaagaaaaatatcgttgttgcagatgacaaatttacccgtcagaaattcacatttaacggaaatgtgatactcggcgctctcggaatggtctgtttaaatattggctctaatatttcatttggagcaatcacggccagcatggcaggagcagatacctttaatgtggaccacctgaccctgatctcttcccttgcggatatgggttcctctttcttcggaggcgcaccggtggaatcgataatttctgctacggcaaatgcgccccacccggtttgggccggagtggcgatgatgattgtggtaggcataattctgttaagcggcctgcttccgaaaatcggcaattatgttccgtcctcatcgattgcgggtttcctgatcgtactggggcttttcaagacctttatacttgatgcacccgtagcgctggcaattaatccggcggtaggcggaactgcactcgttgtcacggcaatttcgaatccgtttctcggaatgcttgccggtatcgcagccagagtcctgggcctgtaaggaggagtagcattatggatacatatgaattaaagctttgcggcgtaaagcgagaactgccgtttatcgatttggaggataatctggcctttgccagttttgtaattatgggcgatacggagcttatcacggcctgcgcgccggagctggcggagaagattggggacgtggatgtcattattaccgcggaggccaaggggattgcccttgcctacgaaatcagcaggctgctcgggaaaaaggaatttattgtggcaagaaagagcatcaaatcctatatgtgcggcgtggtatcggtatcggtgcattccatcacgacctccggggagcagcatctgtacctggacggccatgatgcaaagcgtctttgcggcaaaagggtctgcatcgtggacgatgtgatttcaaccggtgagtccctctatgcgttagaagctctggtggagagtgcaaaggggatcgttacaagaaaagcagcggtgcttgcagagggaaaagcagcagagagagacgacattatctttttacagaagctcccgctgtttcacaaatgtgatgataacagctatgaaattaaggaatcataaagtcataagaagtttcattaaataaacaaagaagataaggcagatacctcgcatctccaccaggaatgaaaggtatctgcctttataaatgattactcttgtaagtaaacagatactgtcccgggcgcacgcaccggtcttcgcttcttgtaatttaagaaaaatttaggaatttcaagtacatttcgacatgatgatatatgatagagtataataaagaattaagagtaaaaggtaaagctatttgaatttatatgaatcaaatttgggaggatgaccgtcgacatgcgtattttgattgccgaagatgaagttgaacttgcgaaaggcctgaagttccttctggagaagaacaagttttccgttgatactgtcaataacggagcggatgcactggactactttcacagcacggattacgatgtgatcgtgctggatatcatgatgcccaaaaagaacggaatggaggtgttatctcagataaggagtgagggagcggcagttcccgtgctgatgctcacagccaggtccgagattgaagacagggtcgccggactggaggcaggggcagacgattatctccccaagccgtttgccaccagggaatttattgcaagagtgaaggcgcttgcccgcagaaatgccggatatgccgatacggttctgtcactggggaatgtacggctcgactgtaaccgctatgagctttcctgcaaagaggaaacggtgcggcttaataacaaggaataccaactgatggagctgtttttccagcatccgcattttgtattctctaccgatcacctgatggacaaggtatgggggaaggactcggaggcggatattgacgttgtctggacatacatcgggttcatcaggaaaaagctgaaacatatcggtgcggatattgaaataaaaacagtgcgcggagccggttattcgctggagggcaataaatgctgaagaagatgaaacgccggtttattgcatcggcgatggtggcctttggagccgttatgctggttttggtaacggttattaatattgctaactgttatctgacgactaaaaaacaggataacctgctaaatatcattctcgaatatgataaaaagacattttcgcagcccggtaccggttttccgccaatttcagatatgccctgggcagggggcccggaggcagagttcatgacccgctttttcattgtccgctgcgacagtgataataatgtgacggtaatatccagagcgtatatctcttcggtcgatgaggagacagcgcggaattatacggaggaaatcctggctaaaggaaaggtaaaaggttactttaaagattaccgctactgtgtaagccgggaggagggagaaataatcctcgtttttctgaacgcatccaacgccctgcagtttatggagtcgttactgattgtatcggttggcataggcattgtcagcctgctggttgtcttcctgctcgtcatgattttatcccaccgggcaatacagccttatgtgaagaatatagagcgtcagaagcggtttatcacggatgccggacatgagctgaaaacaccgctgacctccattgcaaccagtgcggatatcgccgccatggagtatgaaggggatgaatggattgccaatatacaaaagcagacagcccgtctgacccgtctggtaagtgacctggtgacgctttccagactggatgaagagatgataatttacgataagacggtattttccctcagtgacgctgcctgggaaatcgcggagccttttgcttcgctggcaaaagcaggcggaaaaacgtatatccagaacatagaggaccgtttggagatggaggcagacagaaattcgattcagcagttattatccattcttctggacaacgcattgaaatactccgatgagggcggcaaaatccggctggatatttaccgcagccacaatcgaatctgcatgaaggtatttaacacttgtgagcttcaggggataacggatctggagcgcctgttcgaccgtttttaccgtccggacgaatccagatccactaacaccggaggcacaggaatcgggctgtccatggctcaggctatcgtggaggcgcatggcggtaagattacggtgaacagtacggatgggaaaacaattatttttacagtggttatttaatcttacgataacccggcacgttccggtacggattatctgtttcaacgcgaaaggcacattacaataatattgttgtaatgtgtctttctttgtgtcacattaaaaataaaccccctgctatgcagggggagggcagttctttagattaaagcatctcctgtgctagaataaatgtaggtctgcaaaccacaaataaaaagcacaggaggtccaaaatggacaagaatagtttagcgcatacgagatgggaatgcaagtatcatgtcgtctttgcccccaaatatcgtcgtcaggtaatatacaaagatgtcaaagccgatgtagggcagatactgggaacattgtgcaggagaaaaggaatcgaaataatagaggcacagtgcatgccagaccatgtacatatgctgatacgaattccaccgaaatactcagtgtcagaaataatgggatatttaaaggggaaaagttcgctcatgatattcgagaaatatgcgaatttaaagtacaagtacgggaaccgtcatttctggtgtcgtggatattacgtagacacagtgggaaagaatacagcggcaatcaagagctatatccagaatcaaataaaagaggatttggaatacgaccagatgacgttagtagagtatatcgacccgtttacgggtgagccggtaaagaaaaacaagaagtaaacctcttggagaggtagtaggtgaacaaagcaaaccagcaagccccttttggggctgggccggaataaggaagcactggaaacgcccttttaagggcagctgtgaatgtggtgcagttggcagaccttcagtgcgccttccgggcgcaagcaggtaataaccccttataggggtggtgcaagccaccggctaagccggtggtcttgactgctgtctgactgttaattgttcgtagaattttcacatttcatttcaagtacatttcaggctgactttttataatagctgatgatattatgtgcagtaatcttctcagactgagaaaaaacaaaaaaattcaggaggtttgctatgataacagttgagcatttgaccaaatgttacggtgacttcatggctgtcagcgatttgtcttttgaaattgatgaagggcatgtgtacggctttttaggaccaaacggcgccggaaaatcgactactatgaatattatggccggatgtctgtcggccacggaggggaaagtaataatcgacggccacgatatctttgaagaacctgaaaaagcaaaaaaactcataggctaccttccggaacagccgcctctctacatgaatgaaacaccggtggaatatctgaaattcgttggcgcggcaaaggggttaaaaggacgggagctgcagaggcaggtggaggaggtgatcggccaggtaaggattgacgaagtcaagaacaggctgatttccaagctttcaaaaggctacaggcagagagtcggtatcgcccaggcgctgctcgggaatccgaaggttattatacttgatgaaccgaccgtaggacttgatccaatccagatcatcgagatacgtgatctgataaaggaactcgggcagacccataccgttattttaagctctcacattctttcagaggttcaggccgtctgcggcaaggtcctgattatcgccagaggaaagctggctgcatttgatgaaccggactggcatcaaacggcataacttttacggcagaggccaccggggaggatgccgcaagaattctgtctgcaatgaaatctgtcacagagtggacctttgaggataaaggagacgggaccgttgagattcacgcaaaaacagaggacagcaattcacgcgacatttgccgccggctcttttttgcctttgcggccgaggggaaggcaattttgagcatgacttcaaagaaagccaatctggaggatgtatttattgaactgaccgaaggcgaatccggagttgagagaaacggtgaccgggaagagcaggatattccggcagtggctgatgagaccggaaacgctgaaaattccggaagtgacagtgcagaaagtgagggaacggacgaatgacagctgtacttaaacatgaacttgccaattattttcactcattaaccgcatatatttttggtgcatttcttctggtttttgtagggattggggctatgctttacaatattcaggcggcagtgtccaattttgaatatgtactgcaatttgtgagccttggttttgtagtgattgtaccaatcttgacgatgcgcgtcatagcggaggagagaaagcagaagacagaccagcttttatattcccttccgattacaacttcccaggttgttgtgggtaaatatctggcactgctggtcgtattttttattccgctgtgcatcgtgtccctgtatccgctgatttttgcgcagtttggggatgtgtatctgatgacatcctatggctctctgctggcattttttatcatgggcgccgctctgattgccgtcggcacttttatttcctcgttgaccgaaaatcagggatttgccgcaggaattgccatccccgtcatattgtttaactactacagcgtcagcctggcggaacatatatctgcctccgccatgggctctgtcatctccctgtgtgccctggccgttattttgggccttgttatccgcttcctgacgggcaatgaaggcctggcattttcggtcagcctgctgctcattatcattatcgggattgccggttttgtcgatatcagcagttttgaagggcttctgccgaagataatgaaccggttatcactttttgaacgcttttattcgtttgtaaacggtgtatttgattttacatccattgtttactttatatcggtaatcgtgttctttttattcctgtccgtgcagtcccttgaaaaaaggaggtataactgatgaaaaagcatgaactccttaaaaagcctgaacggccgggaagaaacaggattgctcttcggggcggctcttattccctggcaatcacggctgtcgtactggcgatacttattgttattaatattctggcatcagtacttcctgcggcagtgaccaaatatgacatcagttccacaaagctttattcaattacaagcaataccaaggcagtggtcaatgcgctggaaaaggatgtgacaatttattggatcgtgcaatctgatgcggaagacgatgtaatcgaaaatctgcttaataaatatgaaagcctgtcggatcatattaaggttgtcaagaagaatcctgatgtttatccgacttttgcggcacagtacacatcggaaacggttgccaataacagtctcgttgtagaatgcggcgaccgcagccggtatatcggttatgatgatatttatctctatgagccgaatatgacatcctactcctataatgcttcattcgacggcgagggtgcaattacatccgccatcgattatgttgtcaatgaggaaatgccccaggtgtatgttctggaggggcatggggaggctgagcttccggaggcgttcagtgaccagatagaaaaggaaaacatggagttaaccactttctccctgctcacagaagattctgtccccgaagaggcggactgtgtcctaatctatgcgccggccagtgatatttccatagaggaaaaagacctgctggccaaatacgtatcgggcggaggaaaattgatggtactggccgggccggttgagaacggaacactggaaaatctctatagtttactggaggactacggtgtagaagcggcagaggggatcgtggtggagaccgaccagggacattatgcgttccaggcgccgtatatcctgctgccgaatcttcaaagcagtgagattaccgatccgctgatccaggaacattattattctattattcccattgcccaggggctgacggtcaagggagcggattcggcagaggtaacggagcttttgaccacatcggaaacggcattcagcaaaacggacggttacggcctgaccacctatgagaaagaggagggggatacagacggacctttcgccgtggcggtatccgttgcgtgcggaaatgacgggcagatgatttggtttacgtcgtcccatttcctggacgatatgtataatgcctattcatccggggcaaatctggatcttggcatgaatgcattatcatcactgattggtgagagcgaagcggtggcgatccgcagcaaatcactcaactacaactaccttaccatcagtgattccacagcctctctattgaaaacggtgatgattggcgtattcccgctgctgtatctcggtatcggtatctgcgtagtagtaagaaggaggagaaaagatgagccggtctaaaaaactttccgtattacttggggcattgctggcggtctgcctgatcacatttggagtcagtcaatatgaggtgcacaaggaaaagataaaaaacagcgatgaaattattttagagctgccgggtgacacggtgaaatcgctttcctgggaatataattccgaaaccctcgcctttcacaaagacggaaaatggctttacgatggggatggagcgtttccggttgatgaagagaaaataaatgagcgtctggatctgttcagcgaattcggggtttcatttatcattgaggatgtggaggattttggacaatacggcctggataagcctgtctgcacgattcatcttgaaacggacgacgagagctatgagatcctgcttggggatttcagcaagatggactcggagaggtatgtttcgattggggacgggaatgtatatcttgtgaaaaaggatccgctggactactttgatgcaacgctgagcgacatgattaaacaagatgaaataccgcagtttgataaagtgacggggatacagtttacaggagcggaaaactatcagattggatatcaggaggacagcagcctcagctattgcaaggatgacgtttactttatggagcaggacggggcttaccttccgcttgatacatccagggttaacagctatcttgatacagtcagccgcctgaatccaacggattacgtaacgtataatgccacggacgaggaacttagggactgtggtttagataagccggagcttacggtgtcagtcaattatattccgcagacggagaataccgggcaggcagaagagaaaaacgaggaaacatttattctgaatgtcgggcgtgatccggaggagaaaaaagcagcagagaaagcctctgccggaaagtcaatggatggagaagcggcagaaccggaggataagtccgaaaatgaagaaattactgcctatgtaagagtaggacaatcaaaaatcgtctacaggattacttcggatgaatataagaaactcgtcgatgtatcttacaatgcactccgccaccaggaaattctttccgccgatttcgccgatatttatcaggtggacatttctctggagggggaaaattatacgctcacatctgagaaagaggatggtgacagaacctggtattataaggaggaaaaattagaatcctcaggcttcttcgatgcgctgaagcaattgaaagcggacagtttcacacgggagcagccttcacagaaagaagaaatcagcctgacggtttatctggacaatgataattatcccaaagtgcagatggatttctaccgttatgatgggaacgattgtcttgcagtggttgacggaacgcctgtatgccttgtggcaagaaactatgtggtggatctggtggaagcagtcaatgcaattgttctgaattaaggtaatttttattatattaactggcgatggcctgtacgcagagcgtgcaggccatcattagcttttatatcttatcacaatggagacaacaggactcgaacctgcgaccctctacacgtcaagcagatgctctcccagctgagctatgtctccatagaatgattataaacgataggaatggatttggcaagataatactgaattcagatcaatctgcatgttacaattcagccttcggctaaaccgtaacaaatgatgcacagaaacggcaaaataacgccgtttcgcgccgcataactcgggattttcgcaaaaaccagcgaaaacacctcgcggaatacatcatggctgaactgttacatcttcattccacggtataaaatccagatattatcagataataagcctatcaatctgcaaggagcggctaaatatggagcagccaatcatccttcattccgacatgaataatttttatgcttcagtagagtgcctggacaatccgggcctgcgcggaaagccggtagccgttgccggagatcaggaggcgcggcacggtatagtgctggctaagaattacgaggcgaagaagtatggtattgtaaccggggatccgttatggatggcccgacagaaatgcccggatattattttaacgccgccgcgctatgagcggtacattgagatgtcgcaggctgcacatgaaatctatggagaatatacggataaaatcgaaacattcgggctggatgagtgctggctggacgtgaccgcctcctcacgtctgtttggtgacggaaaagtaattgcagacgaaatccgaaataccattaaaacagagctgggattaacggccagtgtcggagtttcctataataaaatattcgcaaagcttggcagcgacctgaaaaagccggatgcaaccacggtaatcggacaggattttaaagagaaaatctggcacttacctgccgatatgctgttgtatgtaggcagggccacgtatttaaaattactaaagtacgggatcaggaccatcggggatttggcctgcagcgatgtgcatttcctggaaagactgcttggaaagaacgggattatgctctgggcctttgcaaatggacttgatcagtcaccggtttcgcatgtccactcacgccgtattatcaagacaatcgggaacagtacgacggccccgcgggatttgaccggtgctgacgatgtaaaaataatattatacattcttgcagaaagcgtggcggaacgcatgaggaaagaaaatttttactgccggagcgttcaaatcagcatacgggacaattccctgttttcatacgaacggcagggcaggctgtctattccctcttgtacctcgcaggcaatatttgaaaaagcattcgaattgttccaaaagaatgcacctgagaatccggtaaggagcctgggggtgagggcctgcagtctgacacgcaaggaataccggcagctctcatttttagaagatgtacaacgagaccaaaaacaggaaagtctggagcgctcaatcgatctgatacgccgtcaattcggccactatgcagtacagcggggaattatgctgacagatgccaaattgtcccgcctggatccggttgcggagcatacgatttatccggaagctttcctgaaaagccagagttaagatcggaatcaggaggaatttgccatgtgcggaagatacagcctttatacggaggaacaggataaagaaatcatgcggattattaaatccctggacgaaaggtatccgggaaatgagatgaaaaagggcgagatttatccgaccaacacggcgccggttatctgccgtatggatggggagatcaggcctgagttaagtacctggggatttccccgttttggagcggcgaagggagtcataatcaatgccagatcggaatccgcaggagagcgtcccatgtttcgcaaaagcctgcacggccgcagatgcgcggttcccagcaccggattctttgaatggacgcagcaaggtgaaaagataaaataccggtttaatctgcctgacagcagagttctttatatggccggaatatataatgaatttaaagatgagaaccggtttgttatcctaacgaccggtgccaatcattcgattgccgatgtgcataacaggatgccggtgatactcacggagcgaaacgtcgaggattggattacttcagaagattttgcattggcctatatccaaacggttatgcctgctcttcgccgggaattagcaggacagacagtcaaataaaacggcgctgaaacgcaaattaacgaagagggcagcgccgccatattataatataaataagcacaccgcaggtcgcaaagcatgacaagggaaaccggctatcgcagggatgaagtgttacaatacgcaaaacagtgggcaatgggcagaaaccccagatatctggattttgaacattatgggggagactgtacgaattttgcatcccaatgtatttatgccggaagcaaagtgatgaactatacgccggtaacagggtggtactataacagcagctcagacaggacggcaagctggacgggtgttacgtatttatataatttccttgtgggaaataaatcagtcgggccatatgccgttgtaacggatgaaacaggcgtgcagccgggagatattgttcagttgggcagtaaagaaaagggcttttatcacagccctgtaattgtagccgtaagagggggacgaatttatgtggcggcccatagctttgatgcatatatgaggccgcttgacacttacatctatgaaaaagcgcgtttccttcatatacagggggtacgtgactggcagcggtaaatgtgctgctgccgcccggaagagttgtacaaaacacacattggcactgatgccgtgaaatactggtaattccgtgtttcatggcatttttttgttctgttatagagcgattgaatggaaatgggatgacgtatatgttacaattcaattatgcagtgttattgcagattatgaaaaaacacataaaaaacatatgaaagatataaggattacaaattgccttgatatactgtgcatgcagacaaaaatactgtaaaggagaattgcatatgagaaatttaaagaaacaaggctttttgtggatggcggtatttacactttgcaccgcttcggctgtgcccgcattagcagcgcctgcttcgccggaggcagtttctgcggtatgtaaagttaagacggtgaacatatcggcagatgaagcgggagaaggcggggagattcgagaaattacatttaaagacggaatgacagggagcatactggtcaacgaacttactgaaccttttaccattaatgcaggtaataacggagagtatattgtgagcatcagttacaaataatcccgacagacagaagctgcaaatccctgccgggatttgtggcttttcgccgtgtttagcgaaaaagcagatcagcaggaaggtggattaggtgagtaaaattctgataattgaagacgaacgggatatagaagaactcctccggttttttctggaggacagcggatatgaggttgccgttgccagggatgggttagaggggattacggcatttcaaaaagacagatacgatttaatcctgctggatattatgctgcctaagatagacggatttgctgtctgcgaactgatacggaaagaatccaatattcccgtaattatgataacggcgctgagcagtgaggaggagcaggtgagaggtctggatcttctggcagatgattatatcacaaaaccattttccatgccggttctcatcaggaaaattgcagctgtgcttcgccgaagcgggagaggggcaaaagccggtgagaatcagaaactcatctaccgcgatctgtgtctggatttagataactatcagacctttgtcgatggtgagccggtagcgctgacgaaacgggaatttgaaatattgagggaacttctgaaccaccagggcaaggttatgaccagggaacttctgttggaaaagctgtggaaatatgagttttatgggaatgacagagtggttgacaaccatattaaaaatttgcgcaggaaactggagagagattatatagagaccgtgaaaggaattgggtaccgtattgataggatacatgagaagccatttgacagttaaaatatttctgataacaaccttattgtttctggctgtatcggcagttacctacggatttatcatcatgtatgtaccgaggtattatataatagaagcggaaaaaatgtcggttaattcagtacagaacgattcggagaagaatgatgcagagcataacatacagtacggcggcataagcaatgataaaatcatttcgttccggacagaggtcaattctccgtacacgttcgaaatcagggaaaatgccagagagttttccgccactctgcataaggtattcctgccgttacttgctgtcgcaatctgtaccgctttggttactcccctgttttactcaagatatatcacccgcccggtgctccgcatcaccgaagtgtctaaaaagctggcggcgctggatttcggtgttcagtgcagggaaaaaagaacggatgaaatcgggatgctggccggcaatctgaatgagctttccggacggctgtcggcggccctggacgaattgaaaaatgcaaatgccatgcttttggaggatgtggcgagagaaaaagagcttgagagccgccagcttgcatttttctcggcggtttcccatgaattaaagacgccaatcacgatattaaaggggcagcttcagggaatgctttatcatgtcggcggctatatagaccgagacaaatatttaaaacggtcatttgagattacctgttcgatggagcagcttgtgatggagattctgactgtcacaagaatgaaagcttccggttttacggcacaaattgaaacctttgatttaccggcccttatttcaggaattttggaggattttgcagacctcttttctgaaaaaaacatggatatcatcacggaaatggaaccccgaaggatgatttcagccgacaggaggctgtttgcaaaagtgatcggcaatctgctcagtaatgcctaccattactcgccggctggggaaaaaatccatattcgggtggaggatacggaccagggcgtgcagtttacggttgagaataccggagtccatataccggagcaggagattgcggacctgtttgaagcgttcacaagaagggagcagtccaggaacagggaaaccggaggcagcggtctgggacttgccatcgtacgcatggtgctggaactccatcaattcccctatgccatggaaaatacggaggacggcatgcggtttcgcattttatttccgcgtaggccccatgcgtcatgaaacggattgcatattgaattaaaataaccggtttgttataatgaatacagcaattcatttcgcagaaaggataaaagaatccatgaagaattttaattatcacatcccgaccgacatctattttggtaaagggaaaatcagggtattaggagataagataactgccataggaaagaacatcctgcttgtttacggcgggggcagtatcaagaagagcggtctttatgatcaggtgattgatgagcttaaccgggccggcgtgacagtatcggagctgccgggcgttgagccgaatccgcgtattcagtcggtgcgcaaaggaattgaaatctgccgtgcaaagggcatcgagggagtccttgcagtgggcggtggaagcacgattgactgtgccaaggttatagctgccggcgcatgctatgaaggggatgcctgggagcttgtgctggatgcacgtaagataacgaaagcgcttccggttgcgtccgttcttactctggcggcaaccggttccgagatggacggctttgcagtcatatcggacatggagaaaaatgaaaaatggggaaccggaaatgatattacgaaaccggtattttcaattctggatcctgagtacacattcagcgtttcaaaataccagaccgcctgcggtacttcagacatcatgagccatacctttgaaaattatttcaacagggtgccgggagcctaccttcaggccaggatggcagaaggcattcttaagacatgcattaaatatgcgccggttgccatggaggaaccggataactatgaggcgcgtgcgaatttgatgtgggcgtccagcctggcaattaacgggctgatcagttacggggaagatgccgcatgggcggtgcatccaatggagcatgaactgagtgcattctacgatatcacccatggagccggactggccctgctcacgccgtattggatgcaatatgttcttcgcgaggagactctcccgcggtttgttgaatatggcgtaaatgtgtgggggctcgatccggatcaggaggatatggcgattgccaggcaggctatcacaaagacgagggagttcttcgattcgataggaatgccgtcgcatctgagtgagcttgacatcgatgatacacatttcgatgtgatggcaatgaaagccgcggccggcggtttggcttatggctttgtgccgcttgataagcaggacgtacgccgtatttacgagatggccctttaatgggaataacggtttgattaaagcagcagctgtcatcagagtgagttgacagctgctgtttctacagtccgaagcaacatgccatacacctgtcatgttccatttgataatatagtggaaaaacaaaggaggaagaggaaatgattgaatcgagatgcgggctgttatgcagtgaatgcgaatataaggttcagatgaattgcggaggatgcgtacatattaagaaaccattttggggtgagagctgcccggttaaggcctgttgtgaatcaaaagaaaaggaacactgcggccactgcggtgaatttccctgtgatttactgaaacaatttgcatatgacgagaaccagggggataatggaagaagaattgaacaatgtaagctctggaagtaaaaatgaacggaatttcatatgacataaggggattttcccataatgttaagtctgattgacagatttcctgctgcaaatggtagaaatagttgacaaaaaatagtatgattttgctggctgagaaattttgccgactaagaaaaacggcaggagggaaatcatatggaattcagagagcaattaatggaactgagaaaacagagaggctggtcacaggaacagcttggggcaaagatcggtgtgacgaggcagaccgtatcaaaatgggagacgggtgacaccacaccggagcttgcgaagctgatagaattaagcagtttatttgaaatctcagttgaccggctgatagggatagaggaacgcaaggatacggcgcctgtatatattcatgagaccggatggaattatgaatataagagtaaaaccacattatggggactgccgctggttcatattaatgtggggagaggtctgcgccgtgcaaaaggagtgatagcggtggggaactgtgcggtcggaattataagcacaggcggtttatcagccggaatcatttcaattggaggattatcgggaggaattgtctcgattggaggactttcaattgcattgctgctctccgtgggagggatgtcaatcggaaccatagcgctgggcggcctggcggttggatattttgcagccggcggtctggcacttggcgtttactcactcggcggatgcgccgccgcatccagggtagcggccggaggagcggccagaggtgtgattgccatcggcgatcaggtcagggggactgtcgaatttccactgaagaacggcgtatcctcagtagagataaggcaggcaattcttgataagtttcccggcacctggaaatggctggtcaggctgtacggcaccctcggccgctgagagcgccgtacagaccgtgtgtttactgccatttataccgtctgtatggaattacgttcctgattctcccggtatcatcatccggattgccggggaaagtcgcaattcatcctcctgtataccatggctgagcagataattttcagccctgtggaacaggcggatggtcatttccctgacaatcagggagcattcccggaagcggttctgcccgatacactccgctattgctttagtaaattcctcgtcagccttttcaagccaggccgtttctttatgggaagtccttaatggatagccccagagaaaaagcccgtatatttttgaatagatatggcggcacccttttatggggcagtacattgcgatacaaaggagaatgtgccacagtgaaaatgcacatctgccggagcgcaggttttcttccagcctgcaaagcaggctgcttttctcgtcgggcgtgagccggagaaaagtggcgcaggcggcttcttcacatgaaaggatgattaattcaaatacctggaagaaaagggcaagattgcgccggacggcaggtgttgagaaatcgggagtttcgatactggccgggcatacgcgggttccgattccgttgactgattccactgccctgaaccggctgagcacatcaatggtcctgcgcatggtactgacggaaacctgatattctctggccattttctcataggaaggaagatatggcgtctcacggtatttacccagatagatttcatgcaggagccgcagcgaaagactgtaacaaatctgagggcggccataataaattctccagataaatggaatttgcccggcggccggtgttatattccgcgtgatgtaactaatagcccgttccgtggtgtttttctggaaagcaaagagcgtgctgcggagcctgtcccagtccctgttcattgtgcagtcaattatttccccaattcctttttctaccagctttctgctgtaaatattttcatcaatatttctgtcaaaaaatatcagtcccgtataaaaagagatttcccaatgcagattgataatcagaggattttccagcttctgcagaatatagcagaagaaatacagggcatcatccgtatctgcccggcttaaaaagctcttgagctgtattagatcctgctgactggtgcggcgcagcccttccatgagaactggaatgagaatcagggcagatgtttcaaacagatccgggaaagcagcggtgcgcttcgaataaaagctttgaacggattcatgaaacgcctgctcagtctgctggaaaatcactctggtaggcctgccgttgtgcatgtcgatgaagccatcttcacgtaactgccggaaagcagcttttacagtctgttgtgagacattaaactcccggcagattgaatcgatggaggggagcgttaccccgtacctgtaatgcctgaattgaaaacgcattacaaaaaaatcgtatatcagatttgagatttgatgcttcttgttcaaaggttttgaacctccattgttctgaacttatgcagatgattacaatacaatcattattttatcattatcccgattaaaaggccaggagtacattgagcttttgaagcttttgtgatatgctctaaaagagacgtacatgaacaaggtggcttcaaaacgggaggaatcaacagatggaagagccggataaagcggtaaaaatagaaaagaatgatatgcaggcagcatctgccggctatgaatatgaaacgctgatgcgcctgatgggggtcagcgtcagtaagcatctgctggatcagcactttacccttatctgggcaaatgaattttattataaactgatcggctggcctaaaaaggagtatgaagaacgtttccataaccggccggatttgtattacgcggatgctccggaagagtggaagaagcttacacagacggtcttaaaggcaatagaggacagacagagcggctatcagatggtctcacggctcaggaagaaaaacggggattatgtctgggtgcagttttcaactcaatatgcagatgaatacatagatggttaccaggtcgcttattctgtgctgacgaatattgataatgtggtcaggatacgcaaggagcagtcggttacttatgaaaatctgccgggatttgtggcaaagtaccgggtggaaaaaacagaggatgattttaatttgattctgcttgatgcaaatgacaggtatctcgaacacttcggagaggttcgggacaggggaacagatgaactgtaccgtaggaatttattggataatgcggaggttataagtgaacaaaagggaaatatactgtcaggagaaccgctgcattttgttgtgcaggtcagagatctcagggaccagacattctggctgcaggtgaatgcaggctgtgtggactggcagggcggaggccctgtttattttgcaattcttattgacatcacagatgtgactcagcttcgcagaatgcagaaaaaactgacggagcagacggaggcgctaaaggacgctctggctgtggcggaacgggccaatcacgctaagaccgattttttatccagaatgagtcatgaaatccggacgcccatgaatgccataatagggatgacaacaattgccggagcctatattgaagaccgccagagagtggccggctgcctggagaagattgggtattcttccaagcatctcatgtctctgatcaacgatatactggacatgtcaaaaattgatgcggggaaaatgaaaattgcgcatgaggcatttgacttgaagacggttgccgaatccatcacctccattatctatcctcaggcggttgaaaaggggcttctctttaccgtaccgctgattgagctgaccgagacggttatgattggggatgcgatgaggctgaaccaaattcttctgaatctgctgtccaattcactcaaatttacgccgaagggcggcacgatccgtttggaaataaggcagatacagcggaaacgcagccgggtgcgcctgggctttacggtctgcgacaccggctatggcatgagcagggaatttatgaaacgcctgttcactccgtttgaacaggagagtgtggctgccggacagaagttcgggggaaccggtcttggaatggcaattaccaggaatctggtgatgctgatgggcggaacaatctccgtgaaaagcgaattggggaaggggactgctttctcggtggaactggactttgacattccggaaagcagtgataacacggaggaacaaaagccgcctgccatggagtcactgaaggtgctggtatcggatgacgatcgcaacagctgcatccatgcatctcttcttctgaaaaatctggggatacgttccgattgggttctgaccggagagcaatgcgtggagaaagtcaggattgcccatcagatgggggaagagtatgatgtctgcctggtggacctgaagatgccggatatggacgggattgaagtgacaaaaagaataagggagattgcaggtccggatacaacaattattattataacagcttacgactggggcactatagagcagaatgcacgtttggccggggcaaatgcgtttctggcaaagccgatttttgcgtccacactgtataataccctgctttcggtgacggggatcagcagaacggtgatgctgccggaggagggcccccagtcggagcatccggaactggcgggccgccatgtactcctggcggaagataacgagctgaacagggagattgcggtggagctgctgaaaatgaccggcattaccgtggattatgcggaaaacgggaagatagccctggaaaagttcttactatccggtgacagctatgatttgatattgatggatatgcagatgcccgagatggacggataccagacggcggaggcgatccgtaaatcgggacatcccagagcagccgacatccccatcattgccatgacggctgatgcgttccatgaggatgtggtacgggcctatgcggcaggaatgaacggacacctggcaaagccgatcaatccggccctgctttatcagacgctggccgggaagatagaaactgcccgctgacgcaaaagaaatatatttctttatccctcttttgggcttgcagcaggtaattctgcccttaatcagctataactacggcgcagggaagatggagcgggcaaggagcgttcttcgatattcaattgttatgtcgagcgttattatggttgtggcaactgccttttttataataatgccgaaatcattgttgtcaatattttcaactcgggaagagattcttacgatagggactacggcattccgtaacattgccctgagctttattcctgcatcattcggcctgatattcagcgtttattttcagggaatcaacagagggaaggaaagcatctgtatcacgctccttcgccaggtggttctgcttgttcctctggcatggttcctgcattttgcgggccttgaatgggtgtggctcacatttccgattacggaagtgatcgttttagcagcatgtctggcgctatacacaaagcagcaatcaggaaaccgacattgaaacgtgttatttgtaaaggagagctatgggaacggagaatttaaaaaggcatatatatgatacggtaaaggaatggcagatgaaaattggaagtctggatgaaagtatcggtctttattatccggctgaatcacttaaaagtctgctgggtttagagcagtctgccacgcgcaggcaactggatggagcgcttgagaaattttgcagggaagtttatccgcaattgggagaaactgctttttcatgtcagggtgaacgttattgcattgagatacctgaaaagggatgtgcttacattgcagaagaaattccggagcctgaatttttgaaaaattttctatcggctatatcggacggagaacattcgcttgaacgggttcggaggtgtttcagtgattttgctgataaatatggagaaagctacagagaagaggacagggaagcggaaggtatgggatgtgtgttctgctttgagaatgatgattttgagccttatgtttattgtgtggaatcggatgaatttggtctgacctatcatcggtttaccagggaggattatgaggagctttcccggtaggactgccctgcacattttataggacaatggcatattctgttattagcagtatgaactgctgaataataaggatgtgatattatgaattatgatgatatgaataatttaagatgtggaaatccggatatgtcttcttcctccgggcaggaggaaaatcagtccctgagatgtcagggaaatagtacaggagactattcggaaagaagatgttgtcctggtccgggaagagtttgctgtcaggggccaacaggcccacgaggctgtccgggaccgatggggccgcggggctgtccgggaccgatggggccacggggatgtcccggtgaacctggagccagaggacctcaggggcctcggggagcaaccggagccagaggacctcaggggattcccggagccacaggcccgcaggggccgcagggaattcagggccttcgtggagcgacgggagctaccggagcaaccggaaggacaccgactgttacggtagcaggaacaattacgggagaaccgggaactccggccgcagtttatgaaaatgttacaccgagcggagtagagcttttgtttaccattccggcaggagcaaccggcccgacaggtccaaccggagcgacgggagcagccggaacggcaggagcaaccggcccgacaggtccgaccggagcaacaggagcagccggaacggcgggagcaaccggcccgacaggtccgaccggagcaacgggagcagccggaacggcaggagcaaccggcccgacaggtccaaccggagcgacgggagcagccggaacggcaggagcaaccggcccgacaggtccgacaggagcgacaggagcagccggaacggcaggagcaaccggcccgacaggtccgaccggagcaacgggagcagccggaacggcaggagcaaccggcccgacaggtccaaccggagcgacgggagcagccggaacggcaggagcaaccggcccgacaggtccgaccggagcaacaggagcagccggaacggcgggagcaaccggcccgacaggtccgaccggagcaacgggagcagccggaacggcaggagcaaccggcccgacaggtccgacaggagcaacaggagcagccggaacggcgggagcaaccggcccgacaggtccgacaggagcaacgggagcagccggaacggcaggagcaaccggcccgacaggcccaaccggagcgacgggagcagccggaacagcgggagcaacaggcccaacaggagcaacaggagcagccggaacggcaggagcaaccggcccgacaggtccgacgggagcaacaggagcagccggaacggcgggagcaaccggcccgacaggtccgacaggagcaacgggagcagccggaacggcaggagcaaccggcccgacaggcccaaccggagcgacgggagcagccggaacagcgggagcaacaggcccaacaggagcaacaggagcaacaggagcaacaggcccaaccggagcgaccggaacttccgtgacagccaacagtatgaacgcgaccaactcgacgggagacacaataacagttattctgggcggaacagccgtaccgctgccggatttccaggtattagacggatttacgacaactgctcaaaatacaacatttaccgtaccggcaacaggaacctatatggtttcttacagagtatcgacgacggcagcgctgctgttatcaacgagggtgctgcgcaacggaacgcccctgggcggatctaccttcacaccggccttatcggtcagctcttttgcagcaactaccttcgctgccttgacggcaggcgatacgcttacactccagctttttggtctggtgggggcagccgtcctacagtcaggcaacggtgccacacttaccgtaatacggcttgtataagcgacgtaatgagtcagataaagccggttcattccggtaaggatacccgatagcgtcaaagcgtgaatgcataaaatgagcccgtttaaacaaacatagcgttttgtttaaacgggctttagcagttgtcggtgaatatggtcttatgcctgtaaatcgtcatgtcttttaaatttttatataaggttaataattcatataatctttttagtgttcttttctatttctttccattttcccggagacgcgctttctttttttctgataagcttgccttggcttaaggaggtttcattatgagtatacaaatgctgactcagatttttttacaatacggcgcattatttatttttctgttagttttgttggaatatatgaatcttccgggacttccggcaggaattatcatgcctcttgcaggcatttgggcttccaaaggaaaaatcagctttgtgactgttatgataatcacagttctggccggtcttttgggaagctggctcctatatcttctgggcagacttggaggcggcctgtttataccatggtatttgaaacgctttccggggcaaagaacgcgcatagaaaaataccttgaaatgctccgtaaaaagggggctatgagtgtgtttataagcaaattgattccggtaacgcgtacgatcatctcaattccggccggagcagtgaaaatggattttctattgtatactatcagctcggcaggaggaatactcatctggaatttcgtattggtgggagccggttactgggccggtgacgcggctttgaaatggtttgcattgaattaagattaatacagatttgagcttaaagacgggtgcttttcatgattttcacaaaagggcatatactatcgttatatgcaggccggattatctggtttgcaattcaggacaagccgttgcacagaaaggaaaattatgaaattcgatgcagtttattatgagcccgacagtctgaactatgagcttggcagagagctgaaagaaaaatatgccggtctgccatggtttcccattgccagccataattcgataaaggaaatgcaggaaaaaccgaattctgaatttggaaaaatgaagcggaatttaatcatcggtattcgaaaaacccataaatatgtggaaaaccataaagtgtccgattatcttgtgccttacacatcatccggctgtacggctatgtgcctgtactgttatcttgtgtgcaattataataagtgcgcctatctgcgtctgtttgtcaacagggaacagatgctggaccgaattatcaagaagggaaaggacagcagcccgttggtatttgagattggcagtaacagcgatctggtgctggaaaatacaattactgataatctgatgtatacaattcccagatttgcggaggagggaaccggtaaacttacatttccaacaaaatttgatatggtggatcccctccttccgctggaacacagaggaaagatcattttccgcatgagtgtcaatccgcaatccatcataaagcagatagagcttggaacttccggactaaatgagcggatcgaggcggtcaataaaatgtgtgaagccggatatccctgcggcctgttaatagcgcccgtgatattgacggagggatggaaggaattatatacgggcctgctggaggaattgcaggaaactttgactgaaaaaatgaagaagcagatgtttctggaaattatcctgatgacatattcctttatacaccgggctattaatgcagatgcgttcccggcagcgccggatttgtataatcaggagcttatgaccggccggggaagaggaagatactgttatcgggaagataccagggcagaagctgaaacatttctgcgggatgaggttaaaaggattttgggagatgttaatatactctatatcagttaaaagagcctgcctggggcctcttttcgggagtttaggatatctgccggatggcggtaagatgcgcatattgcgtattttaccgcccttttagtctctcgggcaaattatatctgcgcatggacaggtgaatagaaatatgataaaatttgagtaagaagagacgaatttgaagaaattttaattaaatagaaatgattatatgaaacagataataagtaaaatgtattatcagaaaataaaacaaatataatcacaaaaatgcagaagctacaattgaaccggaaaaataacaatagaccggcagaaacagcaaattagcggataaaggcccggaaataatttgctaatcgcagtagaattaactgagacagaaagaaaggacggtgatagggaaggtcggcaccggaaaaagctgccgcaaattagtggaaaataaaaactgcataggaagaaaatgaagaaattccagatgaaaggaatgaagaaactgctggagaataacggaatatcttataacaacaagacgttcactggaagggagagggctacttgaataaaaagctgaaagaaaagattcaggaatccttatcgacagtcctcccgattacggcagtcgtattgctgctgagtatatttttgctgcctatcgatgtggggacgattgcattgtttttgaccggggcctgttttttaattgtaggcatggggtttttccagctcggagctgagatatccatgatgcctttgggagaaggggttggccatcacctggtgcggacaaaaaatctttcgattacaattgtggtctgctttatcgtggggatgattattactgtagcagagccggatctgcaggtgctttccaatcaggttccgtccgtaccaaatgccgttcttgtatggaccgtggcatttggagttggaatttttatgattattgcagttcttagaattttactgaatatcagtcttctgaaaatattaatagtcttatatcctgttctgtttctcgtctcatttttggtgccggccgattttacggccattgcctttgattcgggtggtgtaacgacagggcctatgacagttccctttattatggctctcggaatcggtttttcatctgccagatgcgataagaacagcgacagtgacagtttcggtcttgttgccctgtgcagtatcgggccgattctgatggtattgcttctgagtattttctacaatcccggggacgcatcctattccataactgagatagtggaacttgccacgatgcaggatgtggtccgccagtttatcatcgctctgccgacatacgttaaggaggtatcggtgattatttttcccgttctcctggtttttgcggtatttcagctgtttacgagacagtaccggggcagacagatcctgcgcatgctggtgggactattatacactttaatcggaacaatcctgtttcttacaggcgtcaataccggatttgcgccggtcggtatccggcttggagcggatttggccggaggcccgtttaaatggatgctggttccggtggggattctggtcggtttttacattgtaaaagcggagccggcagtgcaggtactgaacaaccaggtggaagagattacaaacggtacggtgtccagggattcaatgaaccgctgcctttcgattggcgtggccgcagcggtggggctggccatgataaggattctgaccggggttaacatctattggattctgattcccggatataccctggctcttataatggcgagaaagacagatcccatttttgtaggcattgcctttgactccggcggtgtggccagcggccccatgacatccacatttcttttgccgatggccatcggcgcatgtacgggtgtcggcgggaacattacgaccgatgccttcggcgtagtggcgcttgtggcgctggcgccgattattgccatccaggcgacaggcctgctgtacgtttataaatcaaagcagccggtggagactgaggttcctgaagacacggattatgagattatcgaactggaggaggagtaagcatggagggacaaagctgcggttatatattgagaatgctggtgattattacggatatgcctatggaaagaaaagtattaaaaatactggatgatttccgggtgccggtcagatatcagttcagggggaaaggtaccgccaattcggaatttcttgaaatatgcggtctgagcgaaatcagcagggcaatcacaaccggatttgtacggcgcagttcagtccacggtatattccgggacttggacgagaagatgagaatcagagaaaagggcagaggaattgcatttacagttcctatcaacggcctccagagttatctgctgaaaaaactggaggagaaccggccggatattgcagaagagaacggggaaaggaatgaggaggatatgaaggaagatatttcatatgctatgatacttacggcttgcagccagggatacagcggagaagtgatggaggcggccagaagagccggagccaccggaggcactattatgaagagccggaggcaggggccggaagaacctttaaagtttctgggggtatccatccaggaggagcaggaggttgtgagcatcattgtacccagggagattaagaaaaaagtgatgcgggaaatcagcgagaagtgcggatgccggacaccggccaaaggaattattctctccctgccggtggatgaaattatcggcctgtcataaaatttataaacgataacctgcacgatccgtgcacaggtcaccgccatcaatgaatgaaaaaggagagtcccggcagactctcctttttggcgtcatcgcctccgcacttataatgagcagtattttgctgtatatctgttatttgttaccgctaaatgccgccatataaggaaggctgcgggcatcgcttatgccgagctgtccggcgattctggcaagaaggagattggattccgcttctgtcagatgtgacacggttttcttggagcgggaagtggttacagatacaggtttattatgtttcatgataagtctcctttcctacggcattgaaattgtgagggataaaccttttgattcccttccttgacaaaaagggtattgcaatactattatgggctttaaaggaaatcaaaaggtttatatttgttgaatgcggtgaattttgttgtttttcatcgttgacaacactatatcatgtttggattggcctgcctattaccgaatctgtcataacgatataagtaatttgctatgagcaaagggaatgtttgagaaaccctgataaggaggagaaaagatgtatacgaagaatccggagtattttcttacggtcgccagagaaggaagtatttcccgggcagcggaaaaactgtatttgtcgcagccgtatctcagccagtgtatcggcaggctggagcaggagcttcagatgaagctgttcgaccgcagccacactccgcttgtcctgacggatgccggaagactgtatctgagttatctggaaggggtgggaaatctgacggggaagtttgaatcacagatagaggaactgagaacaggcagcagacagattctcaatgtcggcatgacgccgtggaggggctccgtcctgcttcccgacattctgcccgcctatgccgcggcccaccctgacgtgaggattgttctgcatgaataccattccaatacgctggccggactggtcagggaagataagattgattttgccctgatgaatattccgaacaaaattgacggatttgtctatcagattgtgttttatgagagaatgttcctggttgccaataaaatccatccggcggcagcggggatagagacatcttatgaaaatccggcctatataaaccttcaggagctgaagaaagagcgtttcatcctgcttcccaatgagcatgtgatggggcaggcgaccgagaatctgtttgccagaatgaatatgttaaattgtgatattctttatacaaccagcagtacgacggccgtcaatctggtcagcgagggcttcggcctgacgtttattccggaaggcggcatccgccaggttccgcatttgaaccggctggcgttttttacggtggatcatccgccgttctgcgttccgctgttgattctctataaaaagaatgcatttatcacgccccaggcccaggattttattgaaatgacaaaacagtattacgcacgtctcaaacagaaggcatcctattgagaaaaggaatcagcgcaggatattgactgatttctttttacggtgtatcataacggtgttatataacattgttacatttaaggagtttaagaagatacaatggaaaaccagcaaagcagcagcacggcctcggctatcctggaggcgggaaaaaaggagtttttgacctttggctatgagaaagcgtcgttgcggagaatcgcagcagaagcgtcggtcaccacaggagccatatacggttgtttttcaggtaaagaagccatattcgaggcgcttacaggggaggtgtcgcagacgctggtggatatgtataccaatgtccaccgggaattcgccgttctgtccccggaaaagcaggtggaggagctgtccggaatcaccagtcatcatgtgctgtcgatgataaattatatttatgaccattttgacgaattcaaactcctgctgtgctgcggagcgccgggaagcgcagaggcgtttattgcccgtctggccggggtggaggaacagtcctgtttcgactttgtggaggctgtaaaaagcttgggatatcaggtggaggagctggacgacacgctggttcatatcctgtgccgatccttttttcagcagcttcaggagtttatctcccatgatcttccgagggagagggcgttgtcctgcgcgcttcttttagggcggttccagcatgcgggctgggccgggatactgaatctttgagtgattcccggaataaaatgttaacacgcttcagagcagatgggaggaaaacagatggaatgcaggattcgtaagcggaggatgaaagatgcggccgattttgcggcagtgataaataacaaagatatccaggataatctgagagacggactgccatatccctatacggaaaaagacgccggagaatttatcagtgcgatgctggctgccggtgaaaatcagatctatgcttttgcaatcacggttgatgataaagtgattggcagcattggagtgtaccggcaggataacaaccacgcccggactgcggaaatgggatattatattgcgaaggagtattggccggtttgtctactcgctctagtgctgtttttttaaatacattggttagtttaagctaaccaatcgacggcggtgagagggccgcatgaaataaaatataggaggataagaaagtggatggaaagtattgcagcaggaaaataatgacggagctgccgggaacaggtaaaatcacgctgatgacattttccggcggttaccgctggctgacgggactgggctgtgtattgtcgggaataagcgctgtgctggggctttttccctatctgtgcatgtggaatgtaatccgggagacggttattggctggccgggcggctttaacggggaccgccttgtacgcctgggctggctggcggtggcgtattccctgctcagcatgctggtctatttcgcggccctgatgtgcacccatatatcggcattcagaacggccagaaatttgaaaacggttgcgctgcatcatttgacacgtcttcccgccggttattttaaacgggtgggaagcggtaaaatacgccggattattgacgacggagccgggcagacggaaacttatctggcccatcagcttcctgaccttgtgggggctgtcgtgacgccggcagccgttatcgtccttcttcttgtctttgactggcggttcggtttaatcagtctgctccccatggctgccggcctgttttttctgagcaggatgatgggggcgaatatggcggtggccatgaaggagtatcagaatgcgcttgaggatatgaataatgaggcggttgagtatgtcagggggataccggttgtgaagacctttcagcagagcgtattttccttcaggagctttcatggctctatcctgcgttacaaagactgggccatgagctacgcaggctccatgaggattcccatgtgcagttatacggtcagtatcaacggcatttttgccgtcctgattcctgccggcattcttttagcgggagacatatccaagggagaatcgtacgtgacggctgctctggatctcatgttttatatcctgttcacgcctgtgtgcgtgtccatgatggataagattatgctgaccggtgaaaatacgatgaaggcgaatgatgcggtgaaccggattatgaacattgtcggggaaaagcccctgaaagagccggatgtgccgaagaaaccgtcggaatacagcgttgaatttaaaaatgtaaccttttcctattacccggaacagggggagcgggaagcagccggcaaagagggcgcggaaaaaccggagccggctttgaaacaggtatcactgtttgtgccgcagggggcgacggcagcggtggtgggagcatccggcagcggaaagacgacactggcaagcctgattcccaggttttttgacgcggacgaaggaagtgtcaccatcggcggtattgatgtgagggaaatcggaacggaggagctgatgaagctggtgagttttgtgttccaggacagccgtttgttcaaggacagcctgctgaacaacatccgggcagccaggccggatgctgcggtggaggaggtcatgagtgccattcgggccgcgcagtgcggagatattatcaaaaaaatgccccgggggcttgatacggtcattggaacgaagggcgtgtacctctcgggaggggaagtgcagaggatagccctggccagagccattttaaaggatgccccgattgtggttctggatgaggccacggcatttgccgatccggacaatgagtatctcatccagcagacgtttgaaaaactggtggaaggcaaaaccgtaatcatgattgcccaccgcctttccacggtatgccgcgctgactgcatctatgttatggaggaagggcgtatcgcggagcagggaaaacacggggagcttctcagggcagacgggctgtacgccggaatgtggaagaattatcagtcatcggtagaatggaaggtaggtaagagaacatgagcagatatttacagaaaaaatttgccctgggcagacagggcgggaagaacctgacgagggccatatttgcgtgcgcccttaccaatatcgggctgatgttacccgtggggcttctgtttcttttcacgcaacggctgtttggcccccttgtggggcttggaacgccccaaatggggctgggaggatatgtgggaaccagtgtcctgattctggccgtcatctttgggcttgagtatattcagtacgtcgcaacgtttatatcctcctatgcagagagcgcggatatgagaatccggattgcggaacgccttcggaaacttccgctgtccttttttggaaagcgtgatctggctgatttgacgacaacgatcatgtcagactgtacatttgtggaaactgcgttttcccactttatcccggaacttattggggctgtcctgtcaacggcgctgataggcgcaggactgctggcggccgattggcggatgggcctgtcggtactgtgggtggctccggtatcgttttttctggcggcaggcacgaggcccatggtagatcggattgagagaagacaaaaagggaaaaaaatcgccgcctcagacgggattcaggagtgtattgagaatatacaggatatcagggccaataaccggagggaagcgtaccttgagggactggatgaaaaactggcggatgtggagaacatcacaatccgtcttgagttactgaacggaattctggtgacgggggcgcagatgttcctgaaaatcggcatggcgacgacggtgctggccggagcttcccttctggcatccggttccatcggttttatggtttttctgatgttcatgctggcagccaccagactgtacattcctctgagcgtctgcctgcagaatctgtccgcagtatattcgactctccttgtggtagaacggatgaaggcgatagaggaggaaacggtccagggcggcagtaaagaggctgtctataatggatatgatatcgtatttgatcacgtaggattctcatataaagacggggagcaggttttaagggacgtgtcgttcaccgcaaaacagggggaggtgacggctctcgtaggcccgtcaggcggcggtaaatccaccagcgccagactggccgcccggttctgggatattgacaggggaaaaattaccgtcggcggggtcgacgtgagggaggtcgaaccggaaacgctgctgaaaagcttttccatcgtatttcaggatgtggttttatttaacaacacgattatggaaaacatacggctgggaagaaaggaggccacggaccgggaagtgatggaggcagccagggccgccagatgcgaagaattcatcctccgcctgccggacggatacaggaccatggttggggagaacggctccgccttgtcgggaggagaacggcagcgtctttccattgccagggcgcttctcaaagacgcgccggtcattctgatggatgaggcaactgcatcgctggatgttgagaatgagacactggttcaggaggcagtctcgaatatggtcaggaataaaacggtactcatcattgcccacagaatgcgcacagtggcaggcgccgatcggattatcgtactaaaggacggctgtgtggcagagcagggcacgccggaggatttgatggagcgcagaggaatttatcaccacatggcggagcttcagagcaggagcctgtcgtggagcctgtagtactgccgccaggaaatgtgatggcagaagcagtcatgagaactaaaatgataataattatcaatattatttattgacaaattgtcatggttttgttagagtgatattgagttagatagaactaactaaaaggaaactaaaataaaaattatgatatcaggacacaataagagacagaaaataatatcaaggaggaattacaatgtcattaataggaaaagagatcagtgattttactgtgcaggcctttgcggacgggaagttcagggaagtgagcaaagcggatgttgtgggaaaatgggcggtatttttcttttatccggccgattttacctttgtttgcccgacggagctggaagacctggcaaataaatatgaggagtttaaggcggccggctgcgagatttacagcgtatcctgcgacagccattttgtacacaaggcatggcacgatgcgtctgacacaatcaaaaagattaaatatccgatgctggcagacccgaccggacgtcttgccagagactttgaggtaatgattgaggctgacggaatggcggagcggggcagctttatcgtaaatccggaaggaaggattgtcgcctacgaggtgatagccggaaatgtgggaagaaatgcggacgagctttacagacgcgttcaggcatcgcagtttgttgccgaacacggcgatcaggtttgccctgccaagtggcagcccggagcggagacactgaaaccgagtctggatcttgtcggcctgatttaacggaatcagattcagagcgatattttctgaggagagtatatggaacaattttatgatgtaataattgtcggcggcggacctgcgggtctgtccgccgccatctatatggccagggccaggtacaaggttctggtgatggaaaaagaaaaaatcggcggacagattactatcaccgctgaaattgtcaattatccgggcgtggagagaaccagcggaaaggaactgactcaatcgatgaaagagcaggccgaggcattcggagcggagtttgttatggctgaagttcttgacatggagcttcaggaggatatcaaggtgcttcacacgacggcgggagagtaccgggcccttggcgtagtgcttgctaccggtgccaatccgagaaagctgggtttcaaaggcgagaaagaatttcagggcagaggcgtggcatactgtgcgacctgtgacggggaattttttacagatatggaagtgttcgtcattggcggcggctttgcggcggcggaggaaggaattttcctgaccaagtatgcaaaaaaggtaacgatgattgtccgggaggatgactttacctgtgccgcgaccatagcggatcaggtaaaagaagaagagaagataacggtcaggttcaatacggagattgtggaggcaggcggagagtccatggtttccttcgcccgtttcagagataacaggacgggggaagaatggacccgcgaagcaggggaagacggagcgttcggaatcttcgttttcgccggttatgtaccgaataccgcctggatggatggtaaggtggactgtgataagcagggttacctgattaccgacatgaaccggaagacgaatgtggacggcgtttacggcgccggtgatgtgtgcatcaagaatttgagacaggttgtaacggcggtgtccgacggcgcggtggcagccacgtcattggaaaaacacgtatcggccatacatgataaactaaatatccctgaactgcccggaaatgaggctcaaacggatcgcccggcatcccgcgccgcggcagacggaaaaatagaaggcgcagagaagcgtgaaacgttgggccatggggaaaataacggttttctgtcggaggagataaagcggcagcttgcgggactgtttctcaaatttgccggacaggctgtgataaaggcggagcttgatgatagtcctctgtcgggagaaatgagcgctttcctgggagaattcgagggacttaccgataaaataacctgtatcagagatcggcttgacccggcggtaaaagccaaaagagaggcagagggtgaaattttcccggcattcaggctgatgcgcggtgacggcagcggcggcaatatcctgttccacggagtcccgggaggccatgagtttaactcctttgtcattgccctctacaatatggcaggtccgggtcagcctgttgacgaagaacttaagaaccgtctccggtctgtcaaaaagaagacgaatatcaaggtaatggtatcgttatcctgtaccatgtgccctgaagtggtgatggcagcccagagagccgcctctttttcggaatacgtgacaggagagatgattgatctgagacattatcctgagattaagaaaaaatataagattatgagtgttccctgcatggttctcaacgacagccaggtgtatttcggaaaaaagagcctggcggagatagccgcgatactggagagtgtttaaaatttaacccggagaggtgagagcggcgcattcgtaactgcgccgtccctgcctgctttgttgtaattcaaactctattattgataataattctctgctaaaactatagacaagttatagaaggaccgtgtataatgaagttagttacaactaaccaacaaataaatgatttatttcaaaaagacaggagagtgagttatgagcgtagtaatcgtaggcggacatgaccgcatggtaggacagtacaagaaaatttgtaaaaattataaatgcaaggcaaaggtttttacgcagatgtcggcagacttaaataagcagatcggatgtccggacattctggtacttttcacaaatactgtgtcccataagatgatcaaatgtgcgttgggagaggtggacagtgaacgaacggacattgtccgctgccacaccagcagcggcacggcccttacagaaattcttgaaaagcgctgttcctgattcagtaaatctataacagagatagtaaaggctgcatggcatatttgtttgtgttgtgccgcctttttatttatttcattggcaagtccgtccggggaagctaaaaggcctctcgaggatgcgccctgcgtggctatgtagtttggccgctaaagcggccgctctccggcgtgcgggttttcctgctgatgaatggatattagttaaaaaattattgacattcgagttagatgatgctaacctaaagagaaggttagttatagataacttgaaaaatgttttgatttgtaaaagagagaggtccgccgtcatctggaaagtatgggatttgtaccgggcacgagaatgagagtggtaaccgtacataacggcaatgtgattgtaaatttgagagaaaccgcgttgcgataggaaaagagatagcggataagattattgtgtcttcgaagtaacggcggctgtatggttatcgggttttccggtatggaagtgaggagagctgatatgtggcagaaagagcaggtaattcaggaatttcagaagaggggaaagagaataacggggcagcgtgagatgcttctggacgtgattctggaaggaaattggagcagctgcaaggatgtttactacgaggccaggaaaagggatccgaagcttggaatggctactgtttaccggacggtaaataccttggaggagattgggattctgacccgtacctatcgctattccctgccgccggaggaagaataaacggataattgagtatgtttctcaataagctatgttagaattgactaacctggaaaatattggttattatccaaatatcagaacaaagtaaaatttccgtaaaggaagtggaaaaagatgaagaagcataagctatgggcctgggccatggtgttttgttttttgatgacaatgtatacagggtacaggcacgaataggaggacaaaagaatgatggaatgtttcaagtgtaaaaaaataggtctttttttaggcggtgtactgtttggtacggccggtattaagatactggccagtgatgatgccaagaaattctacataaacagtctggcagccgggctaagagcaaaggattgtgtaatgacaaccgctgtgaatattcaggagaatgcagaagatattctggcagaggcgaaagaaattaacgaaaatcgcagacagacggaagtgtttgaagatgaaagcggagaagaaaacctgaaagcttttaatgaagtaacggctgctcccgccggcccggccgcggagtaatcaatcatccgcccgtgggggaacgcccagggcggtattttaatttaacaggaaagttctcctgttaaattaaataaaaaccgctccgcgcggtagcagccaggacagcctctttatgattacggcagataaggagtatatagaatgaagtttgtgattaaacatgagataagagggaggctcagaatccatctttaccagagggagatgagtatccggcaggcggatctgctccagtactatctctgtatacagacaggggtttgtgaggttaagatatatgagagaacggccgatgcggcgatttatcatgatgggaaaagagaagaaattctgaaagcgctctgccggttttcctatggtgacgaacgcctgaatgagatggtaccgaagaacagcggacgggctttgaaccgcgagtacagggaaaagctgattcagaagataacggtccgggcgtttgcgaaattatttctcccgatatcgttccgggccttctatacagtggttcagtcggtaagatatctggtaaaggggctcggctgtcttgcagggggaaagcttgaggtggaggttttagatgccacggcaatcgccgtatccatactgcgccgtgactttgatacggccggttccgttatgtttctgctcggaatcggggagcttttggaagagtggacccataagaaatcagtcggcgatttggccagaagcatgtcgcttaatattacgaaggtgtggcagaatgtggacggcaccgagattctcgttcccgtttcagagatccgggaaggcgactgtgtcaccgttcatatgggcaatgtgataccgcttgacggcattgttgcttttggagacgccatggtcaaccaggcgtcaatgacgggggaatcagttccggtgagaaaggaagccggcatgtatgtatatgccggtacagccattgaggaaggtgaaattacgctctgtgtgaaaaaaacggccggttctacccggttcgagcgcattgtaaaaatgatagaggattcggaacagttgaaatccacggcggagggaaatgcggctactctggcagatgccctcgttccatggagtcttggagggaccgcccttatctggctgctgacgcgcaatgtgacgaaggcattgtcgattttgatggttgacttttcgtgcgccctgaagctggccatgcccctttctgttctctccgctatgcgggaggccggaagcttccatataacagtaaaaggcggaaaatacctggaggctgtggcggaggccgacacaatcatatttgataagacgggaacacttacaaaagcaaggccccaggtggcggatgtagtggttttcaatggacaggagaaggatgagcttcttcggatggcggcctgcctggaggagcatttccctcactccatggctaatgcggttgttaatgaagctgtgaaacgcggcctggtgcatcaggaaatgcactccaaagtggattatatcgtggcacatggaatcgccacttacataggagcaaggagggtggtaatcggaagctcccatttcgtctttgaggatgagagatgcaggataccggaatcgggaaaagaagcgttcgctcatctgccggtggaatactcccatctctttatggcaataggaggcgagctggccgccgttatctgcattgaggatcctctgcgggaggaggcggatgcagttatcagcgccttgcgccgccagggctttaaaaagatagtcatgatgaccggagacggtgagcggacagcacattcgatagccgagcgggttggggtggacgaatattattcggaagtcctgccggaggataaagccggatttgtggaagaacagaagaaaagaggccacaaagttatcatgataggtgatggaatcaacgactcgccggcgctttcggcggcggatgcaggaattgccgtcagcgaaggagcagagattgccagggagattgcggatataacaatttccgaggacagcctgttccagctcgtaacgctgcgggccatcagcgccggcctgatgcgccgaatagacagaaattacaggtttgttatcggatttaatatgggccttatcatgcttggagccggcggtgttattgcgccggccgcttcggcactgcttcataatacatcgacactggtggtcagccttaagagtatgacaaatcttttggactaagaaagtacgggtatcctccgcgcggaatgatgacgcatacggcccgccgcaggcggagttcatgagttttacctgttatgccaggagttttttataggtgaattcgatcaggaaagctcccagcggagcggttatgaggatggccagcacggcgacagtcagaacgatgtttccgcacggaaggcccattgccagggggattcctccgattgcagcctgcacggttgccttcggcatataggcgatcatacagaaaacctctccttcatattaagcctggtttttagcagacagcacagcaccccggccgtccggaacataagaacgcagacgatcaggattattgctgcaggccccgcggcagtggcatattttaaatctacggtagctcccacaagtacaaagagaataatttcggcggctacccacagcttgttgaattttgccgccagtcggcaggctacggccgtcctttctcttttgagggagatcccaatgcacatgactgctattaaagcggaaaatgggaggatatcagtaaaacggtcttccgccgagacgagcaggaaagcaatgctcagaaggagaagcaccttggcggtgtccctcatatgtatttttccaaaataccgggcaagtccatatccaatcacgattcccataagaataccggataatatagacagtggtatccgaagaaaacttacaggtgaaatagtgcctccctgagccaggccggtgaacgcggaaaacattacgatgacaaaaatatcgtctacagaggccccggccagaatcagctgaggaatactttttccggttccgtacccctcctccagcagagtcagcattttgggaacaatgacggcaggagagacagctcccaccaccgcccctaaaatggcggcatccagcacggttatgccaagcattcccggagccagcaggatcataccgaatatttcaaaacaggcaggcagaaagcacatcaggacagcggggcggcccacttttttcaaatcagccacatccagggataaacctgctctggccaggataataatcaatgcaattttgcgaagctcagcagaaatcgacagaatggagccgtctatataatcaagtgcatatggcccaaggagcataccggtaaatatcattcccaacagtgcgggcagatgcatttttttacagatccaccctaaaaacatccctgaaattaacatgactgcaatacttaataacataaattcctccttataacatataaagtgtgccgcaggttattttctgccataagcgcaaaaaagctgacagctcctgcgtgtatccgcagaagtcatcagctcaaataagcggtttcagtataaacaatactgggggagaacttcattcccgactgtattataatatctttccggaacaaaaaagtcaagtgatattagctgcctgatgatatagcatgttactattcacggcctgtattccgcgaggtgttttcgtgcgcattttgcatgaaaatcccgagttgcatcgcgcgaaactgcgtttttgcagtttctgtgcaaggtatcacctccttccggctagaaagagtcaacagcaattatattatacttggtagaaaataaaattacaagataaacgttacaaataaatatcattgagattttataatgtttatgataaaatatatgagtcagaaagtattctgtggattgaaataatgatatttatttgtaggaatcgaactgatgaaaattccctttagtcatttattgtggactaaagggaatttttctttgttcctatactttttgaaaagaaaaatatcattaatttgacacacctttggatggaataactctctgagatataagttgtgaaaggcatagaatgaaaatcagggaagcaggcctccgaaagattccaggacaatattgacatatatagataatcgatatatattatatatagataatctatatatggaggtaatttatggcgtcagataaaaaaacggcagccggcaatacgtctatgctgcttttacaactcttatcagaacgtgatatgtacggatatgagatgattgagactcttggaaaacgttctgagaatctgtttgaacttaaggcgggcacgctgtatcctttgcttcacaccatggaatcacagaagcttctgttttcttatgaggcggaggtgatggggaaggtacgtaaatattacggaattacgaaagagggcagaatagcgctggaggaaaagaaaaaggaatggcagttctataacagggctgtttcccgaatcataggaggtgagctgtgtggagctgaatagttatctggaacaactggaggaacagattcggaatcgaaaggcgaaggccgaggtcatcgaagaaatcaggaaccatatagaagaccaggccgagttttatgaaaaggagggaatgtccgccgaagaagccatagagcaggcggttcggcagatgggagatccggtggaggtgggaattgagatggatcgtatccacaggccaaagccgggcgctcctctgtttctcctggcgtttatgatgagtgtggccggactattgacccagtatttcagcttctaccggtttggtgaggagctggtagtttaccagagggtaattgataatgcctttgcacgccaatgcgtttatgtgctcatggggaccgcagttatgcttgtcatcctctgcgtggactacagcccggtgggcagacatgggaaaaaaatgggagccttgctgctggcgggactgtttattatctgcctgtcagcgcctggctatcttggcagtcattcctacctgaaaagtcttatctatctgtttatcccggtgtatggaggaatcttgtatcagaacaggaaccgcgggtattacggaatagcatccagtcttttttggctggcagcggctttctggattgcagcggcccggattggcggcggattagggattacaattgttatggcctgcgtctgttatatcatgatgacggccgccgtgataaaaggatggtttaacgagaaccggaaggcaggcattgttctgacagccggtatcataccggtttccgcagtcatagcggttcttgcacaactgcagccgtaccagataaaacggattgaagttttattccacccggaacggtatgcccagggagccggttatcaggcagccaggacaagagaagtgatagagggactcaccatgttcggaaccggtggcgtgaaaccggaacagctgcccatccatatgctgccgggtgttcaagacgattatatcctgcttcaggtggcctcggtatatggaattatagcggcttgtcttttggttggcttattggcagtattcttgttctgcctgttccggatgatatataaacagaaaaacaggctgggcaagatagtgggttatggctgtctcatggtgatagcagccgagattgccggaaatctaatgatcaactttggcttttatacaatttccacaggcggactgccgttcttttcatatggcgggtaccatactgtgactatttatgttcttctcggagtgatattcagtatccaccgttatgagaatctggcctgggagagagaagacgggaaaaataagcaggaaaaaggtgtcctggcacacctggggaaataccggatacggattgagcggtgcagataaggggcgccgagtattaatattttgataatatagggtattgacattaaatttttattcaattatgcttttctcagagttaccggtagctctcaataccggcggggaaaatgcgtttcgctgactttttccgccggatataagaaggagagcaaaatatgtatcacggaagatttaacggaacgcattatgagattggcttaaaatggggcgggcttttgctcaaaaacgggaaaaaactgcttgacggggttccctttcccatcactgaggagcggattaaattcagccgccgctgcattccctcatacgaacaatattttcctgaggtgctggaggaaattgaggggatagccgcaggacagaaaatcgcatcggaaaaacttatggccgtgcttctaagcatgtactgcatcatgccggagcagaaatgctcctgtgtggcatttaaaaatgaaaatcacatcattcttgccaggaacagtgattttctgacggaaatagaaaagctttatatgaattgcatttataaaatcaagaaacccgcagcgtttggccccccttattccttccagggaaataccactgcttttgtagagatggaggacggagtgaatgaacgcgggctggcaatcggattaacggccgtctggccttccgttctcggcgccggcctgaatgccgggatgattttaagatatggcctggaacggtgcgccactgtgccggaatttacagaagctttaaaggcgcttccgattgcctcgagccagaccttcaccgcagcagacaggcagggcaatgctgccgtcatcgaatgtaatgcggagcaaacagaaatcagataccaggatgaagaacacccttttgtatctgctgtcaattcatttcatctggattccatgaaacacttcaataacacgcaaatagacaactggaacgcagaggagcggtatcagacaatacagagggcatttgaggcagaagacaagcgggatccggagtttgcaaaaaagatactgtcgggccggtttggtttcatgtgccggtatgagcgggccacaggcaaggatacggtgtggtcggttatttacgacctgaaagaattggagatataccgctgtgaggggaatccttccaggaggaaattcatccgggataaacggtttgcattgcttccataagaaacggcagaaatttaaaaacaaatttaaaatatggaaagcggcccgcagaataatttgcgggccgcggcattccgggccgtccggtcagcgtataatcgcaacagttcagccatgatgtttttttgccgtttctgtgcatcatttattgcagtttggccgaaggctgaactgtaacatataatcagcactttcttatgtaatccttgctatctttcgcataaaatgataaaatgacggtaattaatccttgcccagcgctttcttacgatacagatcgtgagccagtgccgcccggcagggtgtttttgttgattggcggtgaataatgataaatgaaaaccaggacagcttcggcgcctatgggctgtcggacgatatattggaatcactgaggctgctcggctacgaaaggcccactgagatccagcagcaggtaattccggctatgctggagggaaagaacgtggtcgggagagcgcctaccgggagcggtaagacggcggcgtttgcgattcccatctgcgataagataatatgggaggaaaaccttccgcaggcgctgattctggagccaacaagagagctgacggtacaggttcaggaagaagtctttcatatcggaaggaaaaaacgcctgaaggtccctgccgtgttcggcggttttcccatcgataaacagatacggagcctgaaacagaaatctcatattgtcacaggcacaccgggccgtgttatggatcatatacgcagggggagcctcatacttgacaaagtctcctgtctcgtaatcgatgaggcggatctgatgcttgacatgggttttatcgacgaggttaagcagattcttgacctcctctctcctgagtgcaggattgccctgttttcagcgactctgaaaccggaaatccgtgagttcgccggttcccatatccatgatatggtgatgatttttacggaacagccggaggcggcggagaatgccatcacggaggagctttttgagacggataatgaaaataaatttaaggtttttctgaatgtactgtacagggaaaatccacagtgctgtattattttctgcggaacgagggagatggtaaacgtgctgttccaaaaactgcgcagacacaggatattctgcggaatgatccacggagagctggaacagaaagaacgcttgaagaccattgatgcgttccggcggggggctgtccggtatctgatagctacggatgtggcggccagaggaattgatctggagaatatcactcatgtcatcaattacgattttcccaccggaagagagacgtatgtccaccgcatcggacggaccggaagaaacggcaggaccggcaaagcagtcagtctggtaacggctgaggacaggcgtatgcttcagatgacggaggaatataccggacgctctctgcctgtattggtttgccctgagagcagcggggaagaagaaaaaaacttctggaagtcacagcggcttaaaacagaggcaaagccgtccaaaagggcggctctgaatcaggatatcacccacctgtccatcggaggcggcaggaaatcaaaaatgcgtcccggtgacattgtgggaaccttatgcagtatcgatgggatagaagtctcggatataggaattattgatgtcagggaaagcctgacctatgtagaaatattaaacggtaaaggaagccatgtcctggaaagcctgcaggacaagccgatcaaaggaaaaatcagaaaagtgagaaccaccaggggaggaatatgataaaggagtattggaatcagattgcacagaacagggatgtgaggcagaatttaagccttctgaggcaggaagtaaaagacaaagggaagctgaaagtcctgtctttacttgtgaaaggacaggaggaacaattagccgggctgctttggtcggaagatgcaaagacacggaaaaatgctgcgcttttgatgggggagcttggaaatcaggagtttttggagccggtttacgcggcataccgcagagaggagcagcgttttgtcaaaagcgcctacctgtccgccatcggcagttttaattacagcgcttatctggaagaactgaaggagcagctctgtttgcttggaaagatggaggagacgcaggagaacagaaagcacctgatggaagaaatgaggggattatctgccctcgtggtccgggcggaaggcattaagaaccatgaatttaccggctttgaccggccttatgatattgtcctcctgaccaaccgcaattttgcaggcctgacgcaggaggaactgacggcccttaatccggatgccaaatcgaaggtgtttggcgcgggagtcagagccagggtgacgaatttaagatggatggataaaatacggacctggcaggagcttttatttgtagtcagggatatgggaacatgcccgatggaaccgtttaaggcggcagaggtgattaccggctccggcctcctttccctccttaacgaaagccacggcgggggtgaaccatggtatttcagaatcgagctgaagagcaggaagacactggaggagcgaagctcttttatacggaaactgtccggccagattgaaaagctgtccggcaggaagctgattaatacggccacggattatgaagtggagctgcgcctgatagagaataaagagggcaattgtaatctgctgctgaaactctatactttgaaagacaaccgcttttcatacagaaaggaagtcacgcccaccggtatccgtccgacggcggccgcattgacggcggcgctcgccagggaatacatgaaagaaggggcgcaggtgctggatcccttctgcggcgccgggaccatgctgattgaacgccataaagcagtcagggcctacacctcctacggtgtggatatccaggaggatgcggtgcgaaaggccagaaagaatacggaagctgccggtatggcggcccattatatcaaccgtgatttcttccagttccgccacgactatctgtttgacgaggttatcacggacatgccgtttcagatgggacacgttacggaagaagagatatacgggctgtacctgcgtttcttcggctgtattgccggtttccttaaggaagacggcatcataatcctttattcgagaaacagagggtttgtaaggccgctggcggcccggaacggtttctctgttctgaaggaatatgagatctcgaaaaaagaaggtacgtacgtttttattcttaacaggatttttaacaggaggtaaccgatggagaatcaggaacagcataaacgccgtgtccgttataaggggactcatccgcgtaaatataatgagaaatataaagagctgcagccagataaatatcccgagacggttgagagggtgattaaaaagggcagcacgcccgtcggcatgcacatttcgatctgcgtaaaggaaatattggaatttcttcagatacagccggggcagaaggggctggacgctacgctgggctatggcggacacactcaggcaatgcttgaatgcctgcagggaaaaggccatatttatggcctcgatgtggatgccgtagagcaggaaaagacaagaaagcgactggaagccctgggctacggtccggagcttctcaccgtcaggaaactgaactttgcgaatattgatcaggtggcggcggaggcgggaacctttgattttgtgctggcggatctgggggtttcatcgatgcagattgataacccggacagaggcttttcttacaagaatgaggggccgctggatctccgtctggattctgaaaaaggaatctcagcggcagagcgccttaaagatatttccagggaagaactggaggggatgctggcggagaactcggatgaaccttatgcggctgagatttcccgcgcagtaatatcggcgagacgcaaaggtaccgccattgatacgacgacgaagctgcgcaggctgatagaagaggcactctctttcctgccggaaggcgagagaaaggaagcggtcaaaaaatcatgccagaggacatttcaggccctccgaatcgatgtgaacagtgagtttgaggtgctggaagaatttctggaaaaactgccggatatactgtcgccgggaggaagggcggcgatcctgacgtttcattccggtgaggaccgcctcgtcaagaaatcgtttaagcggttaaaaaaacaaggggtttacagtgaaattgcagatgaggtaatccgtccgacagcagaagagtgcaatatgaacagccgcgcccgttcgactaaaatgaggtgggctgttaaggcttaaataaatgaggtttcgctgcagctacaggataaagcatgtttatgattgggggaacgggggagagatacagaaatgacgaaaaaggaactggctcttgaaataataaaacgattaaaagaggaatatcctgatgcgggctgtacgctcgattataaccaggcatggaagcttctggttagtgtccggctggcggcccagtgtaccgatgccagagtgaatgttgtggttcaggatttatatgataaatttcccgatgtgaaggcgctggcggaagcggacgtggataaaattgaggagattgtcaggccctgcggcctcgggcgcagtaaggccagagacataaatgcctgtatgaagattttgtgggagcagtacggagggaaagtgccggaggactttgacgccctgttgaagctgccgggagtcggccgtaaaagcgcaaatctcatcatgggagacgtttttggaaaaccggccattgtgaccgatacccattgtatccgtctggtaaaccggatggggctggtggataacatcaaagatcctaaaaaagtggagatggaattatggaaaattattcctcccgaagaggggagtgatttttgccacaggcttgtttatcacggaagagatgtctgtacggcgagaacaaagcctcattgtgaggaatgctgtttgaaggatatttgcgccggaaatggcaggtgacaggatgacctggaatattgcaccggaagtggtttccctcatttttctgctcattatatggacgtattcgagaaagggaagccatctcccttcatttaagaacagaaccttccagttgtgcctggtgattacgttcatcgcaatcggcagcaatatattgtccacgttcatgatttattatctgcattccggcctgcggtggatgacctggattgtgacgacagtatactttctgtttacgcccctgatgggactgatctattttacatatgcggcagctgttctctttgagggaagctcttcactgagacgggggctcgttttttggatgattccgggtgtggcctactcgctggtggtactggccaatccgctgacgggaatgctgtttgtgcggacggatatgaaaggggaggctgtctttatctcacctatctggtcttttatttttactgtctggccagtctgagcatgacggtaatacaccggaaacagattgagcggacggtatacagcattctggcagcgttcccgcttcttgcggtatttgttattttaatccagcagatttatccggaaattattctgacagggtcggcggctacctgtgctatgctgataatttatctccatttgcagaaccgccagatctcgcgggattatctgacaaatgtgccaaaccgtcaggagcttctggatatgatggggctgctgattaaaaagcatccggaaaaacagtttacactggccgtggtatcgcttcggcagttccggcagattaacaatgtctgcggccagcacaaaggagatgaatttctaaggaaaatctgcggatatctctgtgaaatcggtaccagggacggtgtgtaccgcttcagcggggatgagtttgcccttctcttcacttcggaaagtgacggggatatcaaggagtgccttgctgcgatacgggagcggatgaagcagccctgggaagtagaagagtaccggtttacactgtcggtcgcggtgggagtcatacgccggacacgaagcggcgatacgctggaaacggcaatcaactccatcgaatatgccgttttccaggcgaagacaggcagacatggttttatctgctattgcgatgaggtcatgctcgctgaactggagcgaaggaacagcgtgatacagatattgaaagatgaattgaaaaacccctcctttgaaatgtattatcagccgatctattcggcagaggatggagcctttcattatgcggagtccctgatgcgtctcaatcacacgccaatcggcccggtctatccgtccgagtttattcccgttgccgaagaaaccggccttatcattgaaatcacctatattattctggataaggtttgtaaatatattaacaggctgacggaacaaggaattgaggtgggagcaatccatgtcaacttctcggcggtgcagttttcagaaccggatttggcgcagaaggtactggatattataaaacggaacggaaccccgttcacaaagataaagattgaatttacggagagtactctggctgaaaatcccagactggtcacggaatttgcatatgagatgaaccaatatggaatcatgattggactggatgattttggcaccggttattccaatatttcaacggtctttcacattcccttcggaacagtcaagctggataaaagcctggtatatgctgcaatggaaaagaaaacagcattttatgccgtcaggaacctgataagtgcttttaagaacctgggcatgcgcgtgatcgccgagggagtcgagacagaggagcagaaacggctggttttggactgtcaagttgatcagattcagggattctattattccagacctatgtcagaggatgacatggaggcgtttatgctggcacagagggacagcgcctgcgcgggctcctgatgatgataatgaattattgcggtaaacagaaccgtcgtgcgttcgaaaaagaaaacagtgtatgtggcagcgaaaagatacataccgggaaggaggcattccgtggacacggatcttatctgtattgcagtcagggttgccgtcacctgtatggtctttgcctatattgtatacgcccctctcaggtgccgttataagcacaatgtccctgttacttgcttgctcgtcttgctgctgattgcgatcacagtggcggtgacgattctgttcctgtcgtccggacgtaattattacaaatacagtacctttggaattttgctgtggatttttctggcagtgctgattttctatctgagcgtcaggtgcagccgcctggaaatcctgtttcttgtgcttgtagtactgaatctctacgtgaatatcatggtcgtgggaaaggtaatggggcatgtactccaccttcccttttcctgcgagctgtcaaagctgctttatgcggtgctggtgcttatcggttatatccccctgctcggcagcctgttcttagacctttataaaaaagtgattgagctgaatgtggcatcctcattctggcggtttatctgggtgattcctgccctcacttatctggttttctatgtaaaattcatcagcgattactggaaaaagccggtacatatgggaacgggggatatcctgttcacaattctctggtcttttacgacctacgcgctgttctgggtaacactgcagatgattatccagacgcatgagggcatctctgccatggaggatacaaaacgcattacgatgcagttagagatgcagaaggagcggtatgaaaaactgctggaaaatattgagagcaccagacggctccgccatgactggaggcaccacctgatgtccctgaacgggttttccgagaacggagatatggagcagcttcaaagctatctcaaaaagctgataccggaatatgatgcgtgccgggatttttctctctgtaaaaatcatgtggctgatgtgatacttcaacattatgccggtatggcgcagaaccacggaatcgagacggaaatcacggtggatctgccggaggaatgcggtatagctgatacggatttatgcattattttcggtaatctggtggagaatgcagccgaggcctgtattgctcagagtgaaggcagaaaatatattaaagtgaacgcatgcaggaaaggccggcagttgattttaacgataaagaatacatatggaaatcagattaaccggcagaaggggagattttcctcaactaaacacgaaggagccggaatcggcctggagtcggttaataaagtggtggagaaatatcagggggtcatgaaagtagaatatgacaagacatattttactgtctgcgtgatgctcaatgctcagactgaaccgtgagaatacgcacagtcagccttttgcagccggacaggaaacagttaagggactatcgccgtggcgggcggtagtcccttattgatgacggtgacctgtgcgcggagcgtgcaggttatcgtttatacagaaccgcttttcaccggccggtgaaaaggatttagtttgtaaataactgtgtccagtaatctacaccggaggcgctcttataatggcctactccgattttagtaaaattaccgtttaagatattggcgcggtggccggagctgttcatccagccctgcattacacttgatgcggaagtctggccgtaggcaatattttctccggaacttctgtaattcacgccggcttcgctgagcgcggtggaaaaactgctgccgttcggtcttgtgtgggagaaattagtctcgatctcacgcgctcttctctgggccgcgcttgtgacggaacggtcggctgtcagaggtgataggcctgcctttgcccgctcttcattgaccagatttactacctgagccgccgcatcgtcctggttgatttgtccgtccccggtgatacctccgtcgatgataccgccatcgatgataccgccgtcagtgcctccctggccgccgaaatccgggataggaaacagattatccggcagcatgctgcccggtatctggctgcccggaaacatgttatccggaagctggattccggggaaaccgttttcacagttgaaggaatttaagtttccgctgattacgatagcctgtccgtttcctcccggaagcgtatatgtattgacggcagcctgggctgtcatcggggctgcggctcctgctgcagtcatggctgctgcggtaaaggcataaattaatgattttctcatggtaatttcctccttaatattacataaatattacaatattgttactaaatgattatatcatactatttatggtaattatcaagggaataaatgggaatccggtacagctattgatgcaatactgtaatagggcgtatttgaaaattcattcctgccatctgcctgtcctaaggaataaaacggtagcccagtcctctgactgtgacaatatgttccggtttctgcctgtcctcttcgatcttgccccgcaggcggttgatatagaccatgatggcattgtcatcgactgcgacgctggtgccccagacatgctcataaatcatgtctttggtaaatacctgccccggatgcttcatgaacagcagcatcaggctgttttctttggaagagagggaaatttcctcttctcctttgtaaaagcgcatcgtggaggtattataagtgaacggtccgcagtccaggacatcggagtggtccagaaccatattcttgttgcgccggatcaaagcctttaccttagcacccagaacaaggggccggaagggcttggtaatatagtcgtcggcccccagtgacagaccgtacagggaatcataatcctcgttcctgccgctgataatcataacgggagtctggatgccctggctgcggagcttcttaattacgtcgaagccctccatatcgcccagggtgatgtccatcaggatcatgtcgtaagaatggttctttaaaaggttcagagcggcaagcccgctgtctgcaaccgtggtttccagctcattgctgtgcattaccttttccagcagtctgcaaatcgatggatcgtcgtctacgatcaaaactttatccgccatagtatcccccaaccaatgtttttactttaaactgtgcccgaaatgttcaatacgataataaaaataagatgtacttattgctggaattattataatattaagaagagtacaagtcaatatcaggtgaaaatggagatttaactgaggttgggaggacgcgtccggaacggaccatgtccggtgtggtgagggggatggctgagtcttccgtccccgtgggaagttggttgtggagggggaatccggccggaatgaattgctgcggggaccgtttgcactctttggagtgcgcaacagtgctaagctcgtgagggacctcgccaagcaccggcggactcccatgtccccctccgcaattgattccgcctacttccccgggtcagtttttcaccggggacggaagactcaggcggaagttttcgcggcaccggacatggtccgttccgggcgctgattgtctccaaccttaaatggggaggaccctgtcgctgccactgcgtgtttccggcaggccgatatcaaatcctccacaattttttataaaaggcgcattgaaggcatatcatatttcccgcaaacggtagcactgagtggcctcgacaaggtccgccccccgcacttaacgcgtgagacactcagcggccgcaggccagcggacggggccgatacacccggcggagtctttcgttccggcgaaaaccttccgggagaaggagatactgccgacatcttccggcggagaaggagagaatgatatccggaaggacgttcgcccgagagatgatagctcttaggcagagggagacaaagcgcgccgggcggattttagccctacaagggcaaaatccgggacaacttgagcttcgaactcattcggagttcggagcgaatttgtccgtaaccccggggggctttgccttcctctgtcttagagctatccctcgaagaagcagtccagccggatatcattctctccggctccgccctgcgaaaacaaaaccacagtatctccttctccatccagcgatgccaaccccccgggacgaaagactcatatacacaccccaccaccccgtccgctggccgtaccggcggcgtcctcacctgcttaactaaatctccaaaggaaggattttacgaaaccatgagagaaaaaaaggaagacaacaaaaatatcatagcttttatggccgcagtgctggctgtcgtgctttttctcttttcctgcctgggtttcagcatctgggaggagtataagaaaacgattatcgacaaccagaaaaaacagatgcttctgacggcccagagcctgggagataacctggaaattttcatcgaggagtatgaggcggatttggacagcctctgcacaatggaggccggtaaacgccggaagggaggccatgggaaatgggaaattattcaggaatatgtggactcccatagccggtttgtctacgatgtaatcgtttcggatcctcagggagctgtgttaaaaagtacgaaaggctttaaagtgacgcaaacctattccgtcacagagatagacgaggcgctgagctttcgccagtgcaggctggatgacggcgagatctacctgatactcaggcgcgagtttgaaagaggcggctccatatccattgtgattgatgcgattaattattaccagtccctgatatcggggatccgcctggggacaaacggttatgtggtggtaaaggattccgacggcataatcctgatgcatccggagaagaagcaatggggaatcgacgtcatcgacgggcggcaggagatgtacccggacaaagacctttcaagcctggatcagatggtggaaagccagaaaaagggcgaggaaggggtgcttgaatattattcttactggtggacaaagccgggagcgcccagagtgaagaaaatcagcgcctacgctccggccatcatcggagacggattcctggtgatcagcgccgtgattgattataatgatatctatattcccgtagtggaaggttttacaaaacttgcgctggtatttgtgggaatcatggcggctatccttctgatggctttgtatatggcaaagcttataaaacaaaagaaacatgatacggaagaaatcgcctatctgcttgaactcaaccagatactggagtccatgcaccagagcgaggaacggattgcccatcagcagagactccagattatgggaacaatgacagggggaatcgcccatgagtttaacaaccttctgactccgattatgggatatgcggatctgatgatgatggagctgccggaggattcggagctttacgacagcgcctcagagatatatgaggcctcggccaaggcaaaagagattatccagcagatttcctccctgagccgaaagaacatggagacggcttataaaaacctgaatgccgcaaagatattccggcgggcacttaagatggtccagtccgtctgtcccgtcaacataaagctgacggatgagttagaactgtcacaggaatgtttcctcggaaatgagacgcagatgaatcaggtcattctcaatatctgcgttaacgcaatccatgcaatcggacatcaggaagggacaatcaaggtaagcggccgcaccgcgcaggctggggagcttaaacaatacggcttgtcgtcggtcccgggggactggaggcagtatatcaggctggatatctccgacaacggctgcggtatgcccgatgagattctgaagcagattttcgatccgtttttcacaaccaaaaaggggggcaagggcaccggactggggcttgcccttgttgagcagattatatcctcccataaaggctatatttttgccgaaagccatcccggagagggaagcatattccatatatacctgcccgtcaatgagcagaaggacggggacgagccggatggagagctggagtgtaacgaggcgggggagaagctgctaaaccttttgatcgtggatgataatcccaaagtcttaaaactgctggaaaaagatttcggcagactgggtattgccgtaaccgcatgtatgagctatgaggaagccaggaaccatttaaggggcagggaattcgacgcaatggcggcggagcagagcattggcggcagaagcgcggttgatttctgtatgtcgattcaggggcagtgtcccggactgcagagaattatcatgacggaacaagtcacaaaagaagtgcttgaggcgaaacagagaaaaattattgatgattatattgataaaccggtgtctgcctcctccattctcaaggcgataaggacaattcagacactgaattgacaaagcggcgtaacagttcatgctgcccggacttacaaaacggcgccatttaaggcccaaccttaacattttttaagatttctcttacatgaaattaagagagaaaccgtaagagtgtaaggttgggcttttaaaatagtctcagaacttgatagcttaaagaagaaagaggaggaataaaacatgaatgagactatgcttgcggctttaggctttgcaaccattatcatgatcattgttttactgctgcgcaatgttacggttccggccatcgcttttatcggagtctctactgtgacagcggcgattcttgtgctgacaggaacatttaccgtcagcgaaatgggagattttattaaaagcggtgtttcgggcgtgcattccactgccgcgctgttcattttctccgtcttgtttttcggaattatgacggatgccggaatgtttgaccgcattatcaatgccctgatgaaaaaagtaggcaacaatgtggtgggcgttgccatgatgtcatgtattattgccatgatcgggcatctggacggcggaggtgcatccactttcctgataacaatcccggctatgctacccgtatataagaaactgaaaatgcgtcctaccacgctgctcttaatctgcgtgacggcgatgggcgtaatgaacctgctcccctggggaggccctaccatgcgttccgcctccgtactgggagtggaggccaacgtactctggatgcagcttctgccgatgcaggctgtgggtatcgtaatcgcactttttaccgccttcttctggggaacggtggaaaaaaagaggggggcgggcattaacagcactctggaagcggaagatacaatgatttctgaggagacggcaggtagtgcagaacgaagcggccttatcaggccgaacctgttctggtttaatatctgtctcaccctgctcatcatagtctgtctgattttcctgccggtaccgtcctatttcacatttatgctgggctgtgtcgcagcgctgctggtgaattatcccggcgctaaacttcagaataaaattattaagtcgcattccggtccggctcttatgatggcatccacgattctggctgcaggcgtattcctcggcgtattggaggagagcgagattatgaaccatatggccaatatcctggcttcctttatcccgcagtctatgggacggttcctgccgctgattatcggggtcctgtcggttccgctgaccatgatgttctgtacggattcctacttctatggccttctcccggttctcatcggtgtcggaagcaaatttggagtgaaccctgcacatatcgcaatagccatggtggtatgccgcaactgtgcaacctttataagccctgtggtaccggctacctttttaggcgtgggcctcgcaggcgttgagattaaagaccatattaaaacctgctttttctggatttggggcgtcagccttgtctgcatggccgctggtcttgttctcggagtaatttcgctttaaagataatatctattccatatccgactccttacacctcaaaaaggagaactacctcaaagggggggctgcatggcagccctcctttaaagttgtgaaaacgtcgtattcaattagttgaagttaggaggacgccctgcttaattgacaggttcgaggcgtcccgtcaccacatcgatgacaaaaccgttgatttttacatcacgtgggagtaacggatgcgttcggaggagggagacggtgcgttcagcttcctcctgcggcgtttcaaagccctggaaccagaggttaaagtccagtccctccgcttccatccggtttatggtttcctttgcaatgccgcgggccgcaagatgggaacggatggtaccgggggtaatggaggcaacgccgcaatttgtatgggtgatgaccatgatttcctccacgcccagttccaggacggcgatgatcaggctccgcacagtggtgtcgaaggggtcggtaatcactgctccggcgttctttatcattttaacatccccgtctttaatgccaagggcagccggaagcagttcgaccagacgggtgtccatgcaggagagaactgccagtttttttcgtggatatttaccggcagagtaatgcagataagagccgttgtttacaaagtcctcattgtgttttaaaatttcatcaatcataattgccctcctctggatgatgtttccatttattatagggagccaatcttaacggagaaaggaataataccttaaagattattcagaatcaaattcgctgtacaggcttgggattggttccgggggaatttttttagatttcagactttattggtatttacagcatctatataacaggatatgaaaacaagagacaggagaggtgagacgatgtgtgacggcgtacgtacggaacttataacatttatcacggaaaatcaggagaaattataccgttttgcggtctcccagatgaaggacagggatgcggctttagatacgcttcagaatgcgattgtaaaggcgctggagaattatacggcaatcagaaaaccggaatatatgaaaacatggttttacaggatactgttgaatgagtgtcatgggtacatgaggaaaaacagcagggaaattgcctttgaaccggagcaggtatacaggatgcaggagggtgaaatgcagcccgggcagacagactttgagctgtaccgtcagatacagggactgccggataaactgaggacagtgataattctgaggttttatgaggatttttccctggaagagattgccagggctaccggaagcggcctgggagctgtcaaataccgcctttattcagggctgagacgtctggaaaagaagctgaaggaggagagcagatgaagcagagcaaaatggagcgggagatcggaagaacgaaaaaaatatatgaatcgatggaaacgcctaaggcgctggatgatgtggtgcggggagcgctgaagcaggaaacctgggagcagcgagatatgaggcggcgggtatcagagacgggaacgcagggaaagagaaggggaaaagcggcagtgccgggaaaaaagagtccacacggtaaaatagggctggctgcggccgcattggcagtttgttttataaccgccctgaacacaaatgaagcatttgctgccacagccggccggctgcccgtcataggggcggtctccagggttctcacattccgcaattatgacacggctgatgaagagaaggaaatccacatggaaattccgcagatacaggagccggaggccggcagcacgtcctccccgctggctgcggacgtaaataaggaaattgaaacaatcatggaggcatacagacgtgacgcacagcagaggattgaagaatataaagaggcgtttctggcaacaggaggaacggaagaagcatttgccgaaaaaggaatcaaagtggatgcaggatacgaagtgaaatatgagacggaggatgtgctgtctctggaaattacggcaaatgagaactgggcttcggcctatgggatacagtatttctacaatctggatctgaaaaatggtaagaagctgaccctgggggatttgctggggcaggattataaagagaaagcaaacagcagcatcaggcggcagatggaagagcggatggctgccgaccgcaatctcgtttactgggatggaagcaatggtatggatgggtttaagacagtgggagagaatacaaaattttatatcggagcgaatggaaacccggttatcgtatttgataaatatgagatagcgcccggagccttcggaattcaggagtttgaaattaatagacaggaatagggattcaggttacgggaaacggtaactggcatcatgcaccaggaaccatgtatcaggaattatataacgggagtgtatcaagaggcggtagtctgcggcggcagacggccgcctcttctgcgttaatggcggcgacctgtgcacggattgtgcaggttatcgttccacggttcatcttaagatttcttcagaattatataccataatttttggggattcatccgatatcatgccatctataaacgaggaggagaacaatggaaaaaagagaggcggcaatccaagttaaaaatgtcagaaaagtataccggatgggtgacgaagaggtggttgccttaaacaggattaatctgactatctataaaggtgaaatatgctgtattttcggcacctccggttccggaaagagtacgcttttaaaccagctcgccgggatggaaaaaccaacccggggagaagtgctgatactgggacagcatgtttccaggatgtcggaggaggaactggccgcgttccggcagcagtatatcggatttatatttcagtcatacaacctgcttccttccatgaccgccattgaaaatacggctatgccgttaatgttccggggaatggataaggataagagagaaaaaattgcaaaagagcttctctgtaaagttggcctctcgcacaggctggaccattatccaggacagatgtcgggaggtcagcagcagagggcgggaattgccagggcgtttgtgacgaggcccaaggtgatatttgccgatgaaccgacaggaaacctggattccagaactacggcggaaataatgaaaatgataacagggtttgccagaaaatatgagcagacgattatactggtcactcatgatccgggaatgtcccggtatgcggaccggattgtcacactggtagatggaaatattattggagatgaaaggaaacgataaaatgaacagaaagctggttataaaaagggccgtaatatggatgttaagcatgatgatcacactatgctcggccagtccggtgtgggcaacggaggcggcgcctgccgccgcagcggcagaaaacctcgcggagacgggaaacgggaaaacagaggagattaaaccggcggagacaaacctgtcggaggcaaagccggaggacgcaaatccgccgggagaaaaacctggtgagacagcgccgccggcggaaaaaccggctccggagaaagaaaaagagaaaagcccttccggcagcggagagagcgaagggagcggaaagctgacggtggacggctatgaggtttatgcggctttaagcggtaatagccccatcgacgcgatacgaaagggtaagaacgtcaagctggtggtcagcgttagggcggaggggcttacgacggaggaagcgggaaaaaacgggattacagtttccaagctgtcggacagcttcagaaatgcaggggcggccaaagtaaaggtcacctcgaagcgggatgaaaacctggaatttaccgttaccatcccaaaggccgtttactcaggaagaggcaatgaactgcgcctcagagttaattataagaaatcgggcatcccttcggagacaataacggccgaaatcagcgagtgcgaagaatatgagggaaagggagacaacagcgaggatgccacaggccagcctgtaatccgaatcaaacgtatcagcccgcagacagccgtcggttccggagagtcctttggcctggaactggaacttgaaaatacaagcaaagaatccgatattgaagatcttatcgtcaacatttccccgggaaacggactgtatatcacggatgatacgggttcccaggtagtctcaagtctgggcctgaaacagaaaaagaaaattacggtcaggatgacggcggggcaggaactggccggtccctcccagtccgtcgatattgaaatgaaatataactactattcaggaggcagcctgacatcaggctctctgtcgcagaaggttcagattccggtccgaggcggggcggcgggccagccgctgatacggattggacgcggcagaattgacaggccggtgaatgcgggagaaacgtttcaaatggtaatcaggctggagaataccagccaggataaggatatccggaatctgacggcaaccatagagccgaatgaccagatatatctgctggatgagacggacacgcgacttctgggcgagcttaaggccggaaccgcagtagacatccctgtccggctccaggccggagcggagctttcccaggcagcgtcacagctgctcggactgtccctgaaattcgactatgattccgacaagggcagcagccaggggaccattgcagagaagcttgtaattccgacaaacggcaagagcggtaaaatgaatatcccaactcctaatattatcatccgcaactattcatacggagagaaggtaactgccggccaggtgtttgacctggagatggagatgaccaatacgagcagtgtgactgcggcggagaatgtggtggtatcccttgatacaggggaaggaatctccatcaattcctcctcaaacaccatatacataccaaagctggacgcgggagcggcaaaaaaacagagtattaaagtacaggcgcttttccagtcaaagctccagtcgcctaaaataacaatttcatttaaatacgagtatttagacggaaaggaacggaaacaggcgacgtccagtgagacgatagccattcctgtgtaccagccggaccggtttgaactgaaatccccggtttactcggaaaatttccgccagaatgaggaggccacaatctcaatcccatatgtcaacaaaggcagaggacaggtgtttaatgtggaggcaaagctggagggagatatacctgccctggaaaaagatttgactctggggaatttcgaagcgggaaagagcggcaccatcgattttgtagtgactccgaaaaaaaccgggaaggtagaagggaagatccgcgtcagctatgaggatgaggccatgcagcagaaaacggaggagattccaatcagcgtggaggtaatggaagcccagaacgagcaggctgatttcagtgaaaaagacgaaatggcaaggccgcggggaacggtcctttggccggccacagccctggccgtactgcttgccacagccctgttcgctgcagcaaaagccaggaaaaaaatccgtgacaggaaaatggaagacgccaaacgggaagaacaggacgatgactgggacgatgtttttcccgaggatgaaggcggagaagaggatgagaacggtacggcagaggaagagcaggacgcagaggagaggacagaaaaatgaaaataaaagatctgatcatggtctgccttcagaacctgagccgccacaaagccaggacgatgctgaccgtattgggggtaattatcggctgctgttccgttgtaatcatggtatccattggaataggaatgaggaaagcgcaggagagcgcactggcccagatgggggatctgacgattattaacgtatactctgccgggaaaaatacgaaaaaatcaggaattaatgataaggccctcaaaaaaataaaagacatgaaaggggtggaagccgttacccccaaactgactgcggagaatgtcagtatccagctttttgcgggaaaaaacaacagataccgttctgcctccgcccaggtaaccgggattgatattaaggaagccgagacaatgggatataagctgaaggaaggcagcttcgatcagtggaaacctggaaaaatttttgcaggccagtattttgcctatggttttgaggacacgaaacggccggaggggaaaaacatggtggatatgtatggcggcgactatgatgcgtccggaatgccggttgtccctcccgcctatttcgaccctatgaaaattacagttacggcggagctggaaagcggaagggatgatgataaaaagataacaaagaaattcgagacggcaggaattttgaaggaggattacggaaaaggcgaagaaacagtgatgggacttgtgatgagtctttcggacttaaaggatttgctggaacagcaggcgcgtatcagcggaaaaaaggtggaaaggaacaaagggtataccaatgcggttgtcaaggtgcaggatataaaaaacgtggcggaggtggaaaggcagattaaaaaaatgggatttcggaccagttccatggaaagcatccgtaaaccgatggagagagatgcaaggcagaagcagatgatgtttgccggaatcggagccgtttccctgtttgtggcagctcttggaattaccaatactatgattatgtccatttcagagcggacgcgggaaatcggagtgatgaaatctctgggctgttttgtgagggatatccggaaaatctttcttatggaggcgggctgtatcggttttgccggcggactggcgggcgttgttttaagctttgggatatcggcgttaatgaatctggcggcaggccaggccgcgatgtcctctgagttcgggggatttgggggagagatgatggagcagacgtcgggactgtctgtaatcccctggtggcttgccgtatttgccatcctgttttccgttctgatcgggataggggcaggatattaccctgcatcaaaggcagtggaaattcctgcgctggaagcaattaaacatgagtaaccggtgagcagttttatctgaatgattacaaaaacataatatacgattagcaaacagaattttgctgcatatgatacagtgagcaggcgacggccgaaatgagaatcgtcgccgggctgccgaaaggcggcagcagactgtgtgacagcacatctgcgggacagttaataattgttccgcagatgtgctttttcatttaactgaaaactctcctgttaaatgaaaaccgctctgccaccaatcgatgcacagaaatggtaaaaacttatttataatcaggaggttttttgtatggcaggtacagacagagcgcaggcagggcttacctctgcccaggctgcaaaattgctggaacaatacggaaaaaatgagcttacatccggtaaaaaaggaaaattcttaagaaaagcactccatattttgggagaaccgatgtttttgctgctgtttttcgcggcagtggtttattttatcctgggggaaccgaaggatggggcggttatgttcatctttatcaccggggtggtggggattgacgtgatgcaggaatggaaaacggaccgcacccttgccgcgctgcaaaagatgacggcgccgcgggtgaaggcgctgcgcgacggcagggaacaggtgattcccggggaggagcttgtgccgggagatgtgttctttctgtgtgaaggagacagagttccggccgatgcggtaattttaacgtgcagtgatttctgcgtggatgaatctatgctgaccggggaatccgcgggggtatggaagacggcgaaaaaggatgggccggaggggacagccggtgatacctgctatgccgggacacttgtgatacagggaaatgcggcgcttctgacggagcgcaccgggatcacgacggaatacggaaaaattggcttaaacgtggcggaggccccggaggaggatacgccccttcagcggcagacagcggggcttgtgaaggtctgcgccgccatagcggcagttctgtttctgctggccggtatttttacttatttcagcctttccggcctgggagaagccgagagaatgacaaggagcatcctggccggagttacgctggcaatggcgctgataccggaagaatttccggttgtcctgaccgtatttctctcgatgggcgcctggaggctggcaaaaaaacattcattggtccgccgtctgccgtcggtggaaacgctgggggcagtgtcggttctctgctgtgacaagacaggaacgcttaccatgaataaaatgagtgtgggccggacatgggcggcggataaagacgaacggacgcttttaatgctcatgggaatgggctgtgagccggaggcttatgatccgatggagaaggcgatgctgcaatactgcggggaacagggaatcagtgaagaggaaatcttcggcggcagcctggtgaaggaatacgcatttacaaacggcaaaaaaatgatgggccatgtatggctgcgggatggaaggctgacagccgcggtcaaaggctcaccggagaaggtggcggccatttgcagaagcggtgaagagatagatgaagcgcttcagatcggcaaagacatggccgctgaaggtctgagagtcattgcggtggcatcggcagaggaggatgcggacttttttgaaattccggaggaacccgagggatggaagcttcgcctctgcggcctgatcggcctttccgatcctccgagaccaggtatctcagaggatatcagagtgtgcaggaatgccggcatccgtgtcataatgataaccggagataacggagtgacggcttccagcgtggcccgccggatcggaatagacggcggaaaagttgtcacgggagatgaaatggaacagatgacggacgaggagctgggaaaggctgcggcagaaacatctgtcttttcgagagtcgttccagaacataaaatgcgtatcattaaagcgcttcagaaaaatggggagactgtggctatgacaggggacggcgtgaacgatgcaccggctttaaaatacgccgatattggaatcgcaatgggcctgaggggcagtgaagtatcgagggaagccgccgatttaatcctgctggatgataattttatgacgatagtggagacggtaaaggacggccggagaatttatgacaacataaggagagcggtcgggtatatttttacaatccatctgccgattattctggcatctctgctgccgccgctttttggaaccccgccctccgcccagatgctgcttcccgtgcatatcgtgctattagagctgattatcgatccgacctgttccattgtcctggaacggcagccggcggagccggatatcatgaaaagaaaaccggaagaatcgagaggccgccttttaacgccgcagattctggctaagagcgtgctgcagggaatcgccattgccattgcctcctttgccgtgtacttcttccacctgaaaaattgtcccgatcgcgccgtcgtatcccgctccatgggactgatggtgattatgatttccaacctgtttctggtgcttgtcaactgctcggattcggaatcagcgctccgctcccttttccggcttctgaaagaccgcggaatgctggcggcctttgccgctatggtgctgatgccggccgtgattttctattcaccggtaaatacgtttctgaagctggcccctctgtcggcagggcagctggcggttgccgtgttggtttcggctgcggctgttttctggtacgaggtgattaaataagcaggtgaggccgtcccggcggctgattgtctcacgcgttaagtggggggagaccttgtcgcgaccactaagtggagccttatgcattaactatggcttgggggaattcattccggccggattccccctcacgataacctccaatcggggactgaagactcagacacacaaccccaccacaccggccccggtccgttccggacgcgtcctcttccttcaatattaaagacttatgcttgaatatgttcgttttagtgctataatgattgtatcagattacatatattataaaaaatgtaagaaggatggtactcaccgtgaacaaaagtgaaagatgtctggccatactcgatattctgcaaaagcagcataaggtggaagtaaacgaactggcaaagcggttcgggatttctgagatgacggtccgcagggatttgaacctgctggcccggcaatataacataaccaggacccacggaggtgcgctgatggcaaaccagcccgtggtcagaatgatttcatttgacgaatcccgcatttccaacagggaagcaaaggaaaagatagcggcaaaagctgccacgctgattaagaacggacagaggatatttatagacgcaggctccacaacaaggattatcctgaattatatggatgaggaaacgcgtgcggtaattgtgaccaatcatctgaaggtggcggagcatgccctgcaattcgataatctctcagtgattatgctgggcggtgagatgatccggatcaccaattgcagttccggaagcgtggcggaagagcagattcggaaataccagctcgatacggcatttctcggagcggccgccatagggacggacggcaggctgtatgacggatattcaccggaggcaaggtttaaaagctccattttttcagtcgctaagaggacttatcttttgacggattcctccaaattcaatacctatgatctgaacggttttgccgcgctttcccaggtggacggggtgattaccgatgccgggatcgatgaggagggaatgaacctgctcaaaaaatataatgtggaagtaataattgcataagggctgccgaagccctgcacgataagacagacgacccaccggattagattccggagggtctttttattgatgacggtgaccagtaacgtttcctgtcaaattaaaaccgatcatcggacaaatttgaaacgaacaaatataaacatttaaacagctctgaaatctcttcaattcccactggatttaaattagtgaaagaaattattcaatatatgaacatattagaacaaaataaaaggaataaacgaacgttaaatgtacaaatacaacaaaaaccacaggaaaaatttaggtaaaattagcattgaagtacaaaaactgatgtgttaatatgttcgtacaatcaaatacagctcagatgattaaaaaacgaaaaggaggaaatttttatgaggaaattattatctgtagttttagcaggtgcaatggcgctttccatgacagcttgctcgtccaagccggcagagacaacggcggctccggcagagacgtccgaggcagcggcagaagcagtgaccgaggcggtttcgagcgaggcaaaagaaggagggtacacaatcggattttcgccctatactttgacaaacgaatactttacggctgttttaaacggtgttcagacagcgtgtgacgaactgggctgcgaactgatttactttgatccccagaatgacccgacaaaacaggcatcccagattgatgatatgatcgcaagcggaatcaacgctctcgtttatatcccatatgactccgcaggagcgcagaccgtgcttcagacatgcaaggatgcaggcgtgaaagtcattaacgtagacaatgtaatccaggaagaagattacgatctggttgacggaattatcgcatccgataatacacagttaggatacctttccggccagtgggtggcagagcatcatccggacggagcgaatatcctgattgtccatcttcagacggctgaatcctgtatcatcaacgtagacggattctggcagggaattaaagagaacgtgaagaacccggacgcatttgtggaggttcaggtagtggaaggcaaaggcgccacagacgcggcatttgaagtggtatctgatgcgcttcaggctcacgacaacatcgacgttatctatgcaatcaacgatacgtcggccttaggcgcagtacaggctgtggaagaagcaggcaagacaggctccatcgatattctcggaaaagacggcgctccaatcggaaagcatgcaatcaaagacggcacaatggttcaaagctctgcccagaggcctacatacatgggatatatgggagtcaaagaggcggttgaccttttaaacggaaaagaaatcacattcaatacaagcattgagtcttacagcattacggcggacaacatcgatgagtatgaccttgatgcatgggattctcttgactaaacaggcgctgggaacgttacggttcacaggtaatatcccgcgaggtgttttcgtgtaacagttcagacggcatgaactgttacgtttagtgcaggttctgcacgaaaatcctgggaactcgggattttcgcaaaaacagcgaaaacacctcgcggaatacatcatggctgaacggttactcttgattacgtggttcggctcaaaacgagagtttgagccggacctttttctaataaacggcaaaaattgccgtttacaagaacccaccggagggggcaagatttttgcaaggaagattccgggtttacacgcagcaaaaatcggcacaggaaacgtcataaggaaaagatttatgaggtttcctatatctaacaggcgtaaactttttcagggaatacgaggtagcgtatggacggaacaaaactcttacagatgcaaaatatcacaaaagcatttgcttcaaacatagtactgaccggtgtaaacctttctgtcggagaaggtgaagtggtagccatcctcggtgagaacggtgccggaaaatcaacattaattaagatactgggcggaatctacaaagcagattccggagaaatacggattaacggagaagtgaaaaatatacattctgcggctgtagcgggagccaacggaatcagaattatccatcaggaaatcattctggtgccggccaggacaatcgccgcaaatgtttttatgggtcgggaactcagagataaatttggtcttgtcgatgcaaagaggatggaggaggagacgcagaaggtaattgacgatctgcaccttaacctgagagcggatcagctcgtggaggagctgtccatcggcatgcagcagcttgtggagattattaaagccgtatcggcggaggcgagaatcgtcgtaatggacgaacctacatcttcactgtcccagggggaagtggagactctgtttgacatcatccggctgctgaaggaaaaaggcgtcggtattatttacatatcacacagactggaagagctgtttgcaatcacggatcggattgtcgttctgcgtgacggcaaaatgatcggggatattcccacgccggaggcggataaggacgaactgattaagatgatggtcggccgcgaactgagcagctattatacaagaaacaagcatgaaatcaaaggtacctccctggaggttaagggcctggaacatgataagtatttcagggatatcaatttccatgcacggtacggagagatcgtaggctttgcaggtctggtgggggccaggagaacagagctgatgaagacaatcttcggtgcataccagaaggcgggcggagatatttatctggacggcaaaaagctggaaattaagagaccgcaggatgccatcgataatggtatcgtctatgtctctgaggatcgaagggacgagggcctgattctcaaaaatgatgtgaaattcaatatggggcttgtctgtctcggtgatttcatcaggggagtcggggtaaaacacggggcatgggataagatggtggaggactacagaaagaaattctccattaaaatcacatcctccaggcagctcacggggaacctgagcggaggaaaccagcagaaggtagtgctgagcaaatggctggcgaaaaaaccgaaggtgattatactggacgaaccgaccaggggaatcgatgtcggctcaaaggcggaaatatacgccatcatcgatgaactggccgcagaaggcgtatcgattatcatggtctcctcggagcttccggagattatcaatatgtgcaaccggtgttatgtcatgtgtgaaggaagaatcacaggtgagctggccgaggaagaattctcccaggaatccatgatgacgtttgcaaccagcagagaataaggaaaattatcaggaggtacattatgaaaaagaagagagaacggagcgttccgtttacaggctccgcttattttaaacgcaatatcggaacaatcatcggtctgattctgcttataatcattgtttcaatctcaacaccgaagttcatgacatcgtcaaatcttttaaacctgttaaagtccaactcggttaatgcaattatctgctgcggcatgctgcttgcgatcctgatgggggagattgatatttccgtcggctccactgttggacttacgggcgtcatcggtgcatatatgattacgaatttaaacgcgccggtttggctgaccgtgataagctgtctcgcggtgggcgctctggtgggaaccgtcaacggttttgccgtcgcatatctgcaggtgccggcttttgtggccaccctggccacccagtgtatcggccgcggccttacggaaatcatatcgggcggcgtgacaatccgtgtccggaatgccgcttatacgggactcggcaacttaagcatcggcggagtgtccattattattgtctatgccgcggtgatcttaatcgccacctgggttttactaaacaagacgcgttttgggtactatatctatgcactgggcggtaacaagacggcagccaggtactcaggcgtaaatgtgaaaaaatacaatatgctcccttatatcctaatcggtcttctctgcggagtcggcggtattgtatggtccgcgcgtcttggctcggcggcagccacgctgggaaacggatttgagatggatgccatcgcggcagtcgtaatcggcggaaccagcatgtcaggcggcgttggaaccgtgggaggcacatttatcggtatcctgattatcggcgtaatcacgaacggactgaacctgatgggtatcaactccttctggcagggcgtattcaagggaatcatcatcatggtggcagtcgtaatcgacgtattcaaaaagagccgttccaggcagcagtaagcgtcagttgacaagaaaatcaaaaaacagtgctgagaggtgattttatggcatttgcaggactggatgtgggcaccagcggagcgaagctgctggtctacgatctggacggcgcgatattgttcacggcttctaggaagtatgaggagctgggcagcggcggccgccgggagctaaacccggaaaccgttatgaaaaatgtgaaagaggtactccgggaagcaggcgaaaactgtccggaaaagatagaggccatggctgtcacaagccttggagagtcggtcgtatgcctggacaaagagggcagggtgctggccaattcaatgctgacgggcgatcccagagggattgaagagataaaagaaattatagaaacgatgggggatcagaagatttttgagattaccggcctgccgccaaacgagctttacggtcttccgaaatatatgtggctgaaccggaataccgatgcggtgaaacgggcggaggcaattttgttctatgaagatttcgtcggatacatgctcaccgggcagagaaaggtaagctattcttcggcggccagaagcatggcctttgatatcaggaaaatggaatggtcaaaggagcttcttaagctggcaggaatcagggcagaacagatgtctgagccggtgaagccgtgtaccgtaattggcgccatattaccggagacggcaaaggaactgcatctgagtcccgatatgatgctggtggccggcggacacgatcagagctgtgcggccctgggaagcggattaaaccgcatcgaggctggggaatgcggaatggggacatgtgagttcctgttcacgatgcttccggagcccctgatgacgccgtatatgatggacaatgattttacctgtattccttatatcctgcccggcacctatttatccagcctggaggttaccacctgcggcgccttgaagaactgggcgcgggacagtatcctgaaaggcttcaggatggagtgcgaagagaggggggaaagcttttattcccgtatcgatgaggcggtccgggatatccgaacggaggttatggtcctcccgcagttcggttcggcgggaaaccccgatctgtccatggatgcccggggaaccatcaccggccttaccattcatacaaaggcggaagagatttacagggccatcctggaaggaatggcatttcagatgtatctttcctacgaacgtcttaaaaagctgggaacgaagatggagtcgctcgtggcgacgggaggaggggcggcctccgggctgacgcttcagatacgggccgacatcttcaatatgaaagtattgtccctggtcaacgaggagtcgggtacccttggatgcatgatgatggctgcggccggaactggggcctattcttctttggaggaaggcatcaaacgcgcggtaaagataaaaaaagaatatatgccggacgcccggatgcatgagtactatatggataaattcgggaaatataaaatgctctatgagaagatgcatgattttaaataaaacagtagatcacggaggagataactatgaaacttgtaaatggttttgacttaatggaattcgcaaaaaaacatcatcatgtattaccggcgtttaatacgacaaatctggaaatgaccatagcgatagcaaagggactgatggacgcaaagctgccgggatatattcagatatcctccaataacctgaaactctccaatccgcgtatcatcgccctgatggccatggatgcggtgaaaaattcagaaactcccatcggactccatctggatcacggtaaatcctttgaagacgtcaaggcatgcgtggatgcaggatttacctccatcatgattgacgcctcccatcttccctttgaggaaaacataaaagagtgccgccgggccgccgaatactgccatttctatgggattccggtggaagccgagcttggcgcacttcaggggaaagaggaggacgtggttaatgaggcagagtgcaggacggatccggatatggtggccgatttcgtagagcggacgggctgtgacacgctggctgtttcggtcggcaatgtccacggcttatgcctggatcccaggattgacattccgctgctggcaaagattaacgaagtctccgcagttccgcttgtgcttcacggaggctccggcattccgaaggaagtaatctgggaggctaagaaacacggactcatcaaaattaattacggctccgatttgagaaaagaatacatacgcacatttggcgagagctatgaagcggatcataacgaacacgacgtaatccatctgagcattgaggcagttgaaaatgtcagcagaaaagccagggaactggttaccatgattaacgaaaactaatgaacagccggcggtaaggcgaagggtggattgcagtatggaacacacagaacatacatttttaggcatagatttaggaacctctgcaatgaagctggtactgatagacgggaataaaaatgtgctggcacagattacggaggaatatcaggcggtccagccggagcgcggtttcagcgagattgatccggaaatatggtatgactgtatggtgaatgccatggatcgcatcctgatgcagtgcgaccggagccggatcaggggaatcggggtcacagggcagatgcatacgctggtggttctggatgcagagggaaagccggtgcggcccgccatgatgtggaatgatatcagaaccagggatttaattccgaggctgaaggaggaaataaaacaatttccggagggagaatacctttcccggacgatttccacaggaagcccggcggcaaatctctactggctcaaggaaaatgaaccggaacatttcaggaggatcaaaaaattcctgattggtcccgattatctcgtatacaggctgacaggccatttcgggacggattactgcgaggcttccacctcctgcttatatcaaatcagggagaaacggtggtcgccggagatgagagccatgataggccttgaaaaagagtgctatccggagatccggggcagcgtcctggcggccggcacgctcagccctgatatggcagagcggttttcgctgccccaggagatcgatgtgctgaccggaaccggggataaccctgccacggctatttccacaggctgtctggggaggggctatccggtcatatcgctggggacatcaggcgtattaatgatgccggttgcagagcttaaggataatgcaaaaggaaagatgatcctattttcctttgataataaaagctattcctatcttgtacagggggcggtacagtcgaatggaagtacatttgactggtgggtccgcgggatcatggaggaagatgatttttccaaggtggacagcctgatagacgtggaaaagtcgctggcaggcggagtgattttctatccccatctgtcgggggaaaagaccttgtacgcagatccgtgtatccgcggagcctttatcgggctgagtacggagacagaccgatcggatatgctgtatgcggtgatagaggggctttgtttcagcttccgggaactggccgagaagatgcgccttcctttgtgccgcttcggcagcgtcaaggtggtcggcggcggctcaaggagcagagtgtggatgcagactctggccaatgtgctgaatatccgtattgagcagatggatggaatgataggtccggcatttggaatcgcccttctggcggcttaccactgcggatgtttcgattccctggaacagatttcggagggaactgtgaaaatacagaactattttgagccggaaccatatgcagtggcggcctgtgaagagcagtataaaaaatatctcaggatccagaaggggctgcggtacataacagacgggacagaaatgtagcatgtcctatagcctgtttgaaaattcattcctgccatctcctgcaaagtgtgacgcacatctgacagaaagcaattttcagccacgctctggtgaacgattcggtatcttaatgaatgattctatacatggcggcaatatcttcgccggccatggcaaactttgatttttcgatcaatatattctgtccggtcataatataggacggcataatacggataccctgccagtaaatttcggtatggcgtattttataggtagagacggacggcaccgcatttttgcgggccgtctttctgcttatcatgttgaaggccttttttgccacgtctcccatcagcataattacctttaaattggggaataacgacagctctttttcgagaaagggcaggctctgctcgatgaggcttctatctaccgtggattccggtttcggcattttcaccgcattcgttaggtatattccctgactgagtatatccaggatggtgcctgccctgattcccgcctcctgaaacagcgggagagccgttgtcaaataagctgcgtcaggcccgccgtaaaaatcatctcccgggtcttccggcacaacttcattgatcaggacggcatagatcctatccggcacaacatcgacaggattaaaatacagtccgtccgaaccgggccccgctttttgcaactcttctctgatgttcatgattcgtcctccttgtttttttccatttttcctgaaatggtgtgaagtgcttcctgctgctattataccagggaaaacatgatcagggggtgtcatgttcatttttccgtcattatggcaatgaaatagcttttgaattgtgatatactcagctatagagatacatacaggaaccggcatgaataaacaatcgaaatcaatatgaaacagacatgaatggagaacagcaatggagaaccgaacccgcagtgcaaagctgatgaatattactgctatggccgcatttggcacgctcggctattttgtcgcaaaaattccgctcgcgtcggaggagattgcatttttccgcgcggtgattgcagcggttgtgattttggcgtggcagcttgtcagaggcagaaaatttcgtcttccggccagcagaaaaagcctcatcctgcttatggcttcaggagctatgataggttttaactggatttttctttttgaggcataccattatacctctgtctctgtggcgaccttaagctattattttgcgcctgtaattgtgatggcggcttgccccctgctttttcgggagcggctctcgctgaaacagataatctgttttgcgtgttcaacggccggcctcgttcttgtgatatcctccggcggcctggagggcggcagcagcaatgtcacgggagttggttacggactgggggccgcggttttatacgcctgcattattttgattaacaaatcccttaccggcattgatgggatagacagaacactgctgcagtttctggtaggactgcttgtcatgtttccctatgttctgttcaaatcaggtttccatgtaatggaagcgggaacggtaggtattatgaatctgctggtactgggggtcgtacatacgggaatcggctactgcctctatttttcatcgcttggagatttgaaagggcaggaagcggcaattttgagttacatcgatcctctggttgcctgcgctatgtcggtattcgtaatgggagaggccatgggactgatgcaggcggcgggaggtgtgatgatactaggatttacattgtataacgagcttggagggaaaacaccgtcacatccgcggcaaaagactggctgtgaatagcgctgggattcagtacgtgatataaacggtgacaaataaattttaattgacaaatatgaaaaatatggtaaactaatattagtaatcattattgattttggagcatatatcatattaggaggcgtcaatgaaccatttaccaatgaacgtacgagtccccattgaaaaagacaacccatccatttgcagagatgaggcgctttgtatcaaatgcgggcagtgcagagatgtctgtacggactatatcggagtccacgggacgtatacacttgaacaaaccggaggaacagccgtttgtattaactgcggccagtgtgccaatgtctgtccggtatccagcattacagaaaaatatgaataccgcgatgtcagggaagcagtccgggatccggaaaagattgttatattcaacacctccccgtctgtgaggattgcgctgggagaagagtttgacatggaggacggaagcttcgtccagggaaaaatggtagctttgctccgtaagctgggagcttcctacgtgctcgatacgaattttgccgctgatttaacgattatggaagaggccagtgagctgatagagcggattacaaaaaagaacaggccgctgccgcagtttacgagctgctgtccttcctgggtcaagtatgcggagatttatcatccggacatgctgccgcatctgtccactgcaaagagtccgattggaatgcaggggccgaccgtaaagacgtattttgcaaagaagatggggctgaatcctgaaaaaatagtcaacgtggccgtcactccctgtactgcgaagaagtttgagatccgcagggaggagatgagtgcggccgcagaatacctggggattccgggaatgcgggacatggactatgtaattaccaccagagagctggcaatatgggccagggaagaggcgatagactttgcgggcctggcggattcatcctatgacaggctgatgggggaggcatccggagccggggttatctttggaaataccggcggcgtgatggaagctgcgctgcggactgcatatgaaactatcacaaaacagaaagctccggccgtactttacgaccttgaaccggtacgcggaatggaggatgtgaaggaagccgaggtagtgatagaagggctgaaagtaaatatcgccgtcatatacggaactaaagccgcttcaaaattcattgaacgaataaaagagggcggcaaggaataccatttcatagaagtgatgacctgcccgggcggatgtatcggaggcggagggcagcccaagggtacgctgcaaaaaggcgacgagctgaggaaaaaacgaatagaagggctttaccgcagagacagtggaatggagctgcgtaccagccatgagaacaaagaaatcatagagctttacagagaattttataagaaaccgctgagtgagctggcagagcagatgctgcatacaggctacagagacagaagtgaagatttaggaggaaagaatatgagcagttcagttaaatatcgctgtacaatttgcggatacattcatgagggagaacttacagaaggatttacatgtccggtctgccgtcagccggcgtcagtatttgagaagattgaagagaagccggagaataccggtaataaatatgctgggacaaagacagagaagaatctgatggaaggctttgccggtgagagccaggccagaaacaaatatacatattttgccatggttgcccagagagaaggatatgaccagctggcggagatctttttaaagacagccaggaatgagcaggagcatgcgaagctgtggtttgaagcccttggacatatcgggacgacagcggagaatcttcttgcggcggcagagggagagaactatgagtggaccgatatgtatgatcgttttgcaaaagatgccgatgaggaaggttttcctgagatggcggagcttttcagaaaagtaggcgcaatagagaagacccacgaagagcgttaccgcaagctgcttcataatgtcgagatgcagcaggtatttgagaaggcagaggagagtatgtgggaatgccgtatctgcggccatctggtaattggaaagaaagctccggaggtatgcccggtgtgcaagtattcccagagctattttgaactgagaaaagaaaactactaagtaaggaaaaagtttaaataaccggcggcggtaacagtgcatctttgtgcctgagaatcgccgccggttttcggcatatttagagaatcatccccccgatgaatcctgcaattgccagcggcagattgtaaaagaagaatgtaggcacacatgtatcccagatatggtcgtgctgcccgtcggcattcagaccggatgtgggcccaagcgtactgtcggaagcaggagaacctgcgtcaccaagagcagcggcacaggcgataaggcaggctgtggctccgacgctcatgttcattttcatacacatcggtacatagaacaaagcgataaccgggatggttccaaaggaagttccgatacccattgtgattaaaagaccgattataatcagaacaatgacgaatactactttgctggccccgagtatggcaagcgtggcgtcgatcaaagtgtctacagcgccggtctggtttactacataggcgtacccgcctgcaatcagcatgataaaagaaaccatacccatcaaccggattccttcggctattgttccgtcactgttacgaagcttaacggcgccgccgatgatcatgataagaataccgagaagagcgcccagaggcattgaatcccaatagagctggccgaacagaacgcctgcgattgcgattaaggatacgatatgatccttgttaaggcggattgcctcgtcctccagtgaaataccctccagtgaaatatcctgataatcgcgcggcttgcggaagaaccaccaggagccgataaggccgacaagcattccggcgcccagaatgatcgtatgaggccatacttctatcatctcaatcggcatgccgttggctgtcatgttttcagcaacgattccctggaaaatgacaccgtacccaagcggaatcgttacgtatggggctaccagaccgaattccgtaacgcaggcggcctggcggcgatccattttcatcttgttcatcattacaagcagcggtggaaataataccgggatataggcaatatgtaccgggataatggttccggaaattatggcgcatacgaccagggttgccagaagaatccactttctctccttaactaccgatgcaatccacttggccagcattgtcgccagtccggtttgtgccagagctgctgcaaacgtccccagaagcagataagctatggcatttgttccatttccgttcagtcctgtgataataccccccatgatttcgcctggccccattccagccgcaaatcctgcaaccatagccgatacaagcagtgacagaataacattaagcttgcacagacaaagtacacacataacaataactgaaagtgttaccgggttactaataatttcccacataaaaaaaatacccccttatataatttttaatcagtatatgatatggacgtcgataaaatgccgatagggttttctgccgcaggaagctatgatattgcagaaaactgcaggtatcgacagtttatcgacgaaaccggcctgtattgcggacagataaaagagcagtcagaatatctgctctttactcacagaagaaaacacattatatagaagaaagagcaaaacagctgtttatccggccttgttttaaacacaaaaacctgtaaaaacagcagcttaaaataaaatggaaaaataaaaacaaaaaatgcaaaaaaatggttgacttttctttaggggtttggtattataatactcgcccttgaaaaacggggtaacaaatcaaaacaaagatttgaaaaaaatgtaaaaagttgttgacaaacaaaagcgactgtgataagatataaaggttgctgctgacgaaaacgacagcgaacaacaacaaagaaccttgaaaactgaacagtatgtaaaaccttgaaaattcttaaagaacaaaggcttttggttaagcctagaagttcgagagaacattcagaacaaaaaaaccaaacaacagtaatacggtttaaaaattagccaagcgaatttttgaacggaatcaaaacttaaacatgagagtttgatcctggctcaggatgaacgctggcggcgtgcctaacacatgcaagtcgaacgaagcgatttaacggaagttttcggatggaagttggattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaagaagaagtaaaggttttatatactgttgagttttcgaggatattgagtcaattgcgtagcttttggagctgcaattgatgaaaacctggaaacaacatttccggtgtcgatgcgctcaggggacacacccgttcccatcccgaacacgatggttaagacctgagcggccgatgatactatattggagacgatatgggaaagcaggtggatgccggattttttctatgggggtgtagctcagttgggagagcacctgccttgcaagcagggggtcaagagttcgaatctctccatctccatttgcgcgagcgaaaagaagcgtgcgcatcaagagtcaggactgcgtggaaagtttactttcctaagcagacatgaggattgatgcataggcgtgaaacgccgtgagtgagaaagccgaaggctttggaacggacgcttcgcagtaggacgcgcacagcatgtaccttgaaaactgcatattgaaataatatctagatagagtttcgaaactcttccgagtggcttgccacaagggagaaaagagagacaaaatcaagacatccgaggtgttacacgaaagtgtaaccaaaacaaaccaaaaattttattgtaaacctaaaccaaagattcaacgctatgaatcttagaccaaaacccgcacccgcaggtggaagtcaattggttaagctaataagagcgcagggtggatgccttggcactaagagccgatgaaagacgtgataagctgcgaaaagcttcggggaggagcaaatatcctttgatccggagatatctgaatggggaaacccacttgagaagacctcaagtatccatacgccaatccataacgtatggaagggaacccgctgaactgaaacatctaagtaggcggaggagaagaaagaaacatcgatttcctgagtagcggcgagcgaaagggaaagagcccaaaccagagtgcgtgcactctggggttaaggactgcatacgtgagccgatttgttaatggaatggtcctggaaagaccagccagagagggtgaaagccccgtacatgaaaacaataggcagcagcaggatccagagtaccgcgagacacgagaaaccttgcgggaagtcggggggaccaccccccaaggctaaatactccttagtgaccgatagcgcatagtactgtgaaggaaaggtgaaaaggaccccgggaggggagtgaaaaagaacctgaaaccctgtgtttacaagctgtggaagcacgttaaggtgcgaccgcgtactttttgtagaacggtccggcgagttgcggatgctggcaaggttaagcacttaaggtgcggagccgaagagaaatcaagtcttaatagggcgtcaagtcagcatgtgcagacccgaaaccgggtgacctatccatgtccaggttgaagttcccgtaaaagggaatggaggaccgaacgcacatccgttgaaaagggtggcgatgaggtgtggataggggagaaattccaatcgaacccggagatagctggttctcctcgaaatagctttagggctagcctcgtattagtctgctggaggtagagcactgaatttcctagggggcgtcaaagtctaccgaagaatatcaaactccgaatgccagacagatgatgtacgggagtcagactgcacgagataagttgggtagtcaaaagggaaagagcccagacctacagctaaggtcccaaagtgtgtgttaagtggaaaaggatgtgggatttcaaagacaactaggatgttggctcagaagcagccacacattcaaagagtgcgtaatagctcactagtcgagaggtcctgcgccgaaaatgtccggggctaaaacacaacaccgaagcttaggaatcatattcatatgattggtagaggagcattctatacggagcgaagcagtaccggcaaggagctgtggactgtatagaagagagaatgccggaatgagtagcgagatggaggtgggaatcctccaggccgaatatctaaggtttccagagtaaagctgatctgctctgggtaagtcggggcctaaggcgaggctgaaaagcgtagtcgatggacaacaggttgaaattcctgtactgcatatcatcagaactgtggggacacagaaccgaagtcaaacccgggaatgaaaagaccggggcaagcgtaggactggttaggctggcaaatccgcttaacaacaggaggacgtgacgcgtagcgaacattagtagcgaagttggcgtaggggctgtcaagaaaagccgctattgcgtgatatgtacccgtaccgtaaaccgacacaggtggatgaggagagaatcctaaggccggcgggagaagcattgttaaggaactcggcaaaatgaccctgtaacttcgggataaagggtgcccacgagagtgggccgcagagaataggctcaagcaactgtttagcaaaaacacaggtctatgcaaaaccgtaaggtgaggtatatgggctgacgcctgcccggtgctggaaggttacgaggagaggttagcgcaagcgaagctttgaatctaagccccagtaaacggcggccgtaactataacggtcctaaggtagcgaaattccttgtcgggtaagttccgacccgcacgaaaggcgtaatgatttgagcgctgtctcaacaatgcacccggtgaaattgaaataccagtgaagatgctggttacctgcgccaggacggaaagaccccatggagctttactccagcttgatactgggattcggtattgcatgtacaggataggtgggaggccgtgaagagaggacgccagtcttcttggagccactgttgggataccacccttgtgatactggatttctaaccagccaccgtgatccggtggtgggacaatgtcaggtggggagtttgactggggcggtcgcctccgaaagggtatcggaggcgctcaaaggttccctcagaatggttggaaaccattcaaagagtgcaaaggcataagggagcttgactgcgagaccgacgggtcgagcaggtacgaaagtaggacttagtgatccggtggtatgaaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgcgggcgtaggatatttgagaggagctgtccttagtacgagaggaccgggatggactgacctctggtgtatctgttgggtatcaagcccatggcagagtagccaagtcgggacgggataaacgctgaaggcatctaagcgtgaagcccccctcaagatgagatatcccatcgcaagagtaagaccccttgaagacgacgaggtagatagggcagaggtggaagcatggcaacatgtgcagctgactgttactaatcggtcgagggcttaaccaaaaggttaggttaaggataggatagaggaagcgattccttatgatttaaacggatgaatttcaatatgtggttttgaaggtatatgttatatttataaattgaatatgataatatagagaaacggatgacggggtgtggctcagcttggctagagcgcctggtttgggaccaggaggtcgcaggttcgaatcctgtcaccccgattctaatatatgcgcgagtggctcagtggtggagtatcgccttgccaaggcgagggtcgcgggttcgaatcccgtctcgcgctctcaaaagtaccgtaactacggtactttttttaatgcgtgttgtatttcgtgttgcatgaaccttaaaaattccttttttgactcgcgacaatctgttttatcgtatagggtaagccacgcctggtacttgctcatatccaaattaatgtcatccggttctacgattttttcaaagtacgtatcaatgatattatccaccttttcgcgttcctccgaaaaagtctgcatgtagatttttttcattaccttgtcagatttccagccgccgcgctcttgggcatacttatcgggtatccgcagcaaagccatgacagacgcgctgagatggcgaagatcgtgaaaagtaatatgcgccatgccattgtcatcctgtagcttaatccatcggtgatacagggcccggccactgatagggaccaggatgtctccgtccacctggtcgataagctgcttgatgtaaggcggtatccgatgacgccggttcctggcaggattctttcccatatcctttcttttcgcttctcggccaacatcgacaactacctcacggatagttatataattcccgctgatggattttgatttcgtcagtccgcggacctccgacatggaaaaagagagccacgccgctaggagtaccggcagctctatgtccgttcccttgatgatgcgcagcacgtcggcggcggaagggagttccactattcgctccatgacctgtggcagttcgattttttcaaagttcagctctttttgatatttgttcagcacggctgtgaccaggccccactcatttttcagacgttttggtgatattggcttcgggttcctggcgcgctttcttgatggcctccgggcttccacattaatggcttcctgtaagatttcttcgtccagatcctttaatttcgaatccatgatatcctggaaggcatttttctggatgcagcggtagtcctgtattgtggttggcgaccggttgatagcctcccggctctctatgtaggcgtcaatggcctccgacagggtcatgttcctatactcatggctcttcggccgtttctccttgttaagctggaatagggcggctgcggcctctgcttctttctttccgcgtggcgacgggtcatcagatgtaaaggattcatagacccgcttgcttttggtttttcctgtcttttcatcaatcactttttcagtgtggctgtaggccaggcagcgccaggagcctgacggtaatttttttgctgttgccattatatcatcctttcctattttagggtaaaattaatacgccccttgccaggacgcactctggatgatataatttaggtgtctaaactaaacctatctttccggtagcatccggcaagagcatctatgtgaaaagctctaggggttttcggctcctggggctttttgctgttataagttcaaaagtatctgcttcttactttcaaattcttcttgtgtgatagcccccatatcgagtaattcctttaatgccttgataccttccaatgatttttgggtatccattacaatagactcctttgtatctggtgttgttatatcgaaacaccttagagtggcatcaagcttgctgtcgcatttaaaggatattttataggtcttttttgtatcaacgttgacaagggaaaaaaatgcaattgtacttttttctacatttttttctgtctgctgtagatttgcggttttatgccccttcgttttttccttacctttacttcctgcccccatagcggcaccgacaagtgttccgacgccaggagcgacaaggcttcctaaaagtgcaccagctccgattttcagggccttaccttgctttttagtggtgctctttccgacctcgctggtagacgcattagtaactgtattatattcagggccgttccattcatacgccgagatggtgtaaatatttgatgtgtctgaattaaaataaacggttccatctatccgctgatgtatggataagcctaatgatgataatcctaattctttataaccggaaattggcgtcaatgaggctgaacgattatttttaaattcgttaatatcaaattcttttgtttcaagccaaggctgatgttcattaataaaattaatagtctgaatgattttttcattaacgttgtatccaaaatcaaagcgtatattagtattatcatttcttttaaatagcagaaatccggttttaagtcgagacgcataggaataattaacccctttcataacagaataaggaattgttatcttattcccgataaaagtaataagattaatttcttcttttccgacaaaaagttctttagtagttccttttatactcataaaaattcctccgattaagaattatatctatgctgcgtcatcataaaaatccaactcattaatactctcgttgacagattccaaaatctcatgtttttcaatgtaagaggtccaggccgaagctatgtctgatttgagttctcgcctcaaattgttatataatgtctccattgcttttttccacatctcgccagcggccttttccagctttttgtcttcccagcggtcttttttctgccgctcggcatttttgactcgctggaactgcatggctttaaacataaatgtttgatagccagaaagattcttttctagataatctaaaaactctttgtatttcatatgatcactcctttaaattgtttgctcttaagcgcaatcctattaaacgctcttcataacccaaaatacgcgataattgttcgacagaacatcctgaatattctaataatgtttcatcgcttattaaaaaatccatcccaaatgtatctgcctcatcctcaaattttccggtattaaagcaagtcctagtatccataaatatcatattagcctttttatgcataaacatatggcccatttcgtgagcacattcaaaagcctgctcgtggcgcgataaactattatctatgtaaataatattatttcgctgaaaatactgataaaaggctctcacgtcaatcagtggagcgaatatcagtattacgtttaatccccggataacttcaaatgggtctctgcttcggtgtttccacgccaaagaatcagctaatttttttatatccataaaatcagtcctttttgtacttttttggagtgtacttctccttattctttttcttcgcaagttccataccaatctgcattgctgacaggatagactcgattgcttcgggggtggccggatcaccatcgaacataagtccctcctgagaaaggagctgctctcgcgtttgctcaagaatctttgcaatatctctttcatcttttggagtgagtgtagcttctttcatctttggttcgtcttttcctgtcaaaaggtaatctatgcttacgtcaaaataatctgcaattttctgtaatcgctctgttgtaggcatacttatcttccactttgaaatggatccattggaaaagcctaattctttttctaatttaccctgagatattttatgtgtttttcttaaactttcaatacgttcaaacactgtcacagaaacgcctcctaaatttaccgaaagttttctacaaaaacgcttgacaattagaaagatttctgtataataagagtatgaacacagaaaactttcggtaaaatgctttaataattattggtagcctggtaactacataatagaatattttctgcattttgtcaatagagatacagaatgttttctaatattgctcatgaaaggaggctgatcatgatatatgataaaatcaaaacaatttgcaactctaaagggataagcatacgttctgtagaaaaagaggcaggattaagtaatggtgctatcagcaaatggaatgatgccagtccaacggtagataaacttcaggcggttgcaaaggttttaaaagtcaatatcgaaaaactcttggagtagcaaaacatatgttcgataaaacgactatatcactgtatcggaaatgtgtcaataaaaaaagcgaaaggagtgtgagagagggatgatttttaagaatatctatcaggaactgattctgataagaaaagagctccagagcattcggagtgctgtggagcccaagaaaattgatattaagttcaggggaaaaactatttctcatcaagaaaatcacgattaaaagattcaagtacacgattatatatatcgagatattccgtgtataaatcaatagtgacatttcccttttcctgactttgagcttcgttaacgcgaatttcaaacattttagggaggatagaaaccgcaaaatcatgagcacgtttttcattatcggtcatggtgagtctcctttcttctgtatttcagcatggcaaactgataaggagattgtatcacagggatgggagtaaaacaatatgtcaatgggaaaaggaggcgagagaggatggaagaaaagaaagcatttgaggctttatcgtgcgccaaggaagttgttaaggtgttggaaagacatcatgctacagttaatgatatggaaagagtgcttggtatagtaaaggatatggttttgtcaagcactctagtccacatagaataagattcctgcttaatgagactcgatgaatgtcaagccagaataagtaacacgaacatcagtcagagaaaaatgtggtttgccatccatcgtgcgctggtatgataagccgctcagatatctccgatcaacgcactctgcaagagctgcattaaaatcaccttcatctatagaagaagataaagagttaacagcgataccgtcgcgaatttgaaccaagatgtctttcatagcggaatcaaattctttggttgatttaaacatgatagctctcctttcttatgtactcggcggtgcaacgcctacagtataggtcaggaggctgtgaaaatcaaggaagagaaaggagtgtaagaacatgacagacaagcaaaaagcagccgcccatgccgcctacacccgtcagcaggcagaaaatgttcgagcaattatcagcgaacataaggctcgcagaaatatgaccaatgccggaatcgcgaaggcaatccatatgccactaaggacgtttgaaaagcgaaaaatggatccaggcctttttaaactggaagatttatggctactatgcgaggctttaggtgtaccagaggaacagcgcaagaccattatgtaaaggaggtgataccaatgcacaaacatgattacaccggtgcccaggtcgtccgaatgcggcgtcagctgcgggtagaacgggcagaacgactatggctgtacaggctgctggctgtgtcgttaattatctgcgcagtattgaccggaacgctgctggcagtggcacagacggcagggatgttgtaaggaggaggacaagcatgagcagacgaaggaatggcaccaaccgggccggggctgccatcggcgtaaatatttacaccgggaaactggctccgagaaagaaaaagaacctgccggcggcaaccggacaggctcaggtacatagaaaataatcataccaacattataaagcaaaagtggaggaaatgcaagatggataatagtgacaaaatttatattgcgagtgaaacgtttcaagaactttgtgaattaaaaggtcgtgttacagcatttgaaaggtggctgaatcgcgaacgatattcagtcagcaaggaagattgtgccgctatactggggcttgagctttctcagaaggaggacgaatgatccggtataactgcgacctgtgcggctgctatctggatccgggtgaaggcctgctctgcgacgaatgcagacagaaggtccgggaaaaggcactcagaggtaggagaacacaggggattatacaagaaggcaatggaaaccaggtagaaatgattttacaggaggcggaagcatggttaaaagcgcaactgaattaaaagcaggagatgtcatccgttttgaatatggggactatgataactgggcggaatgcacagttaaagaggccgtaacagtggggaacacggtcaatgtgaagggcagccgcatgggaatgaattatgaattggagtttggcccgaaagagaaagtgcaggtgttacaaaatggagaaactgaaatttaggtgcctaaaggcagatgaaattgactgccggattgcgacagtcagagccaacggtattacactactgctttacaaggatgcccgcgtagaccaaaacatactggatgaaacggtcgggccgatgaactggcagcggcggcattgcagggagaatgcaaactgcatcgtatccatctgggacgatgacaagcaacagtggattgagaaagaagacaccggaacagaaagctatacagagaaggcaaaggggcttgcctctgacagctttaaacgtgcctgttttaactgggggattggccgggaattatatacggccccctttatctggattggagacaaggactgcaagataacggcaaagaagacaggtggaaaagaggcatatacctgctacgataaattttcggtcagccagatcggatatgacagcgaaggcagaatcgacgtcctggaaattcagaatgtcaggacgtgcaaagtggtgtaccacataggttccgggccaaaaacggaacctatcgaggagacaggcaaacaggaaggactgacagaaacacaaattaacacgctgctaaacgaacttgtgcgaaccggaatcggcgtgagaagcatatgcacgaactacaaggtaggccagctctcccgtttgaacatggaacaatttaaagatgccatgaatcagctacgggagaagccggataaagtgcagaaaaaagaaccagatcccgagacgatcccgccggatgatgactgtgggctgccgtggaattaaagaggaggtagaagcatgaattacttcaccgatataaccggttatcgggcggccggggacggtgttgacctgctggtccattttccccaggatatccgataccttatcaaacgccagaatatccgccacgcagaagtgattctggatgatggccgccatatctccatcgaacagcgtaagaagatatatgccacgctgagagacatcagcgactataccggagacccgccggaagtgacaaaagagtggatgaagtactgttatatcgaaaagacgggatgccagtatttcagcttatcaggctgttctgtgaccacggcaagggagtttatcaatttcctgatggatgtctgcctgcgcaacggaattatcctaacggagagcggcctgaagcgtacggacgatatcgatgcatatttaatccagtgcatccggtataagaaatgctgtatatgtggccgccccgcagacgtccatcatgtggatgcgattgggatgggaaacgaccggaggagctatgacgatagtgatagcgagattattgcactatgccggggacatcatgtacaggcccacaatcttggaaatatccgattcatggagcggtacaaggtgtacggaatcaagaaatatcagacagtagaaacagaagactttgggagcttcggagaatttatcaaggtataatgccgcagggattatacatagcaactatcaactttcatgcactttttaggttagtatatcacgatacgatgccacttaagcgtaacgggcggtcagaccgaggctgcccgtatcctccggaggggaggcgaggaacatcaacgaatttgaagtatttacatatagcgtttataacgccctgggaatcggccgtgagaacgcccagacccgacaggagctgtgtcaaaaactccggtgcggggatcgcagcctgaggcgggcgattgaggctctgaggcaggattatcctatcctcacgcaagatgacggccggggttattatctgccgccaacgacaccggaagggcgtcaggaggcgagccgatgggcagccaggcaggacaagcggattaagagtatccggatgtcccagagaggcgccaggaggtttgcaggaggcgcgaggagcaagggagtgcctgggcagattagtatgttcggcggaatgggcggtggatgatgcgagacggaattgttttttacaggagtttttacaacgccataaaggagttgtcggatgccgagcttgcaaaatgctttaaggcgattatggagtatggtctggacgggaaggagccggagacatccgggatagaaaaaaccatttattgtctcgtaaagccacagattgatgccaataataaacggtatcagaacggaaccaagggaggcagaccaaaaaccgaaccagaaccaggcgataaccaaacagtaaccaaagagaaaccgaatgataaccagacagtaaccaaaccggaacctaaagaaaaagagaaagtaaaagagaaagataaagtaaaagagaaagataaagagagtaaaggggctgtgcgctttgcgcctcccacactggaggacgtaagggaatactgcctggagcaggaatatagcattgattctgaacgctttattgacttttacacggcaaaggattggatgatcgggaaaaacaaaatgagggactggaaagcagccgtgcgaaactgggcacggacccagcggcaggaattgaccgccaacgggagcaggaggcaggaatcgaccgccaaaagcaagaaccgctttcacaacctggaagaacactgctatgactatgacaagatagtgtgggagatgatgaacggtgaaaacgaaggagacagtaaaacaggtaattgttgattacatacaggagtatgattacgcaccgtctatacgggagattgcggatatagcttattgtgcacagtctacggcacatcaatacgtacgtgagttgttacggtccggggaactggaaaccagccacccgggaatgcccagagctttgcggctgcccgagcgacgctacaggattgacagtagggcgcttaaggaggtcatagtcggattggccgggtgcgatggggaggacgattatgccagaggctgggatgatgcttttgaggcaattatgcgggcaatggacaagatgaggatatgattacctttgagccattctgggaaacgctgaggagaaaaggaatcgggtttggagtagcggatgattacgtgtattgtccacactgtggggcggaacttgattggaggcatgtgcgtatgctgacagaaagatttagaaaattggcggaacgattgtagacattgtgctgtcctatccaggcaaaacggggcaaggagagcgagaaaccttgtaaaaaatctctggagtagaaaccagataggaaataaaaaagagcagagagctgataacgcaagagagcgcaacgggtgcgccgttaccagaagcggacggaagccaggtccgttgttagggcataggccgaagccggaatgccggtactggcaattttttataaattgacattttaggaggaaaaaaatgaatagaaaaacaaaaaacaagattaaagaaggtgggctggttgcagctatggttattgttgtactgattgcctgctatggcctgagctggatcgttacatgtggaatcattaaattaatcaccatgtgtttcggttggacattcaaatggtctattgccactggaatttggctgattatttgcatattgaaaagcatctttaaaacaaccaatcaaaattgacaaggaagtatatgaagattttcggaaggaaggtgccagatgagaaaggtgcaatggtgtgtaaaatgtaaaaagtatcatctttttgatgatgtaaactggaaatataactggaaacagagaacatgggagtgtttgaaaactgaggatttagaggagggatagaatgacattgagaacacctaaaccgacgagagaagaaagagcagctatgacacatgatgaattactacgctcgatatggttgctggatgaagtaatagagttgtttagatggatcccggtggaagagcagttgccgaaagcgaaagaagatgttttggtttgcacaagaaatgggtggattttgatagcttggtatggtccaaacgggcaaaaatggcatgtaactccaacggatattaagcaagacgacattatcgcatggatgccattaccagaaccatttaattcataaaatgaggatttaaaggagtaatatatgagatcacttttatcgacgcccgcattgaatgaaaagatttgtgatatgaaggaccggagagagaaagataatacatggagtgcagatgacgagcagatacttgcttttcttgtcgagctacatattttgcgaatttctaaggcccatgcggaaaacgaagccaagggaatcacagaaacaatatataaaatacatgatgaaatgcaggacgagagagggttactagtacgttaaattgacattttgaggagaacgctatgaacgaaaaaacattacagtgggctgcaaagcagttagagcagctacgaaagccggcattgttaaacagagccaatggtccatgtgtatcatgtaaatttgaacctgaatgccaatgggcgcatgagtttgatgtggaggactgcaaggattgggcggcgaaagaggaggacggggaatgaagagaaaacggaataggcgctgtcatgcaaaagggaaagtaatagtatggcctggtcgtatggaccggtgccagaagagtgattgtaaaaagtgtcattgctattattagcatttaagccaggaggtaattatgatagtttgcgaagaatgtaagaagtgcagtaactatatggtatgcgagaatggctgttatgggagtgataggccatgcgaatatcttgtttcagatacagataattaggatttcagagcggtggagcaggaataaaggggggattacaacgagcaagacagattacataaaagtggcagagcagcggcgccgtcgggcatccgcccaggactacatcctgaaggggccacggccggagacctggtcggcggtgatgccggcatattgttacacggtgctatgtccggtgccagagctgcgggtcaacactggtggacagataggaggcgatgacaatcaaaaataagagcaaaacagagctggccttaatgggagctattttcctggaggatattgataagtgcagacaacgggtcaagataggagatgcgtttaatgtggccgacaacgcctggaaatgtgagaagggcaatggtgtgcggccagttatgcgtggccgggtgacggctaagtatccgcactttgtgatacttgattgtgggacatccattacatacgttcagattatccaataccggcgcaagcgtggtcgaaataaatttgtggattaatgggggtggtgccagtgggaattaagataaccaggaagctgctggatgattaccggcgcctgaagcgggaaatacctctcctggagctggagctggtcgagatgctgcagggggataacggtttcgacaacagcacaatctttgattaccggaccggagaggcgataccccagagcgttgtgggatttgactggaagctgcgagggcatcgcgagaaggtattggatgggaaaaaggataaggtcaaagcggttgaaaaatggattgaggccatagaggacgggcaaacacgatgtgtatttaagatgttttacattaatgggatgacatgggacaggattgcggcaaagaccggatatagcaacagtccagattatccgcggctccatattagagatgactatttaaaaaagtgccaaattaagtaaaaggtcgtttaagtcggaaaggtcgttgtagaatacaatagaagccaaaggccttaaagccagcggctcccctccccttttcggtcgccagtgtgtaacagcctggtggtcgattcgccggtatcgcgtaacccctcataagccaggctctattaacgggcaatgccgcagggcacgcgtccggcactatatgtaaaatgcgaatgtaaggtgaacccaccgcagggggaaccgatgaaagaaatcctctccgatgtcagccggcgaggcaggcagtgataagtatatagcaaggccgactaaagtacggtgaagcgcaagctggaaacagtggccgagcgaaggaacatgggagacgtccctgggcggagttgcgaggggctgctgatgccaatgcggactggtcaaaaagttacccttaattgaccttaccaaaaacaatacagggctatgccgggaaaccggcacatgtggagcatcccaccaatggcaggtggacaggggcgcgccctgggttccggttcgattccggatgcgccgcttgtatctggttttatctcccaaagacatttccagatacggattaggcacttggcttatggctgagtgccttttctattcctttttggtatttgaacaattagaacatatgttctatactgattatacaaaataggcgtcaataatatgggaagaatttccagaaaggatgtggtataatgtaaaaaaatgtcgatgggagagaagcacaatgccgtctattggtttgtctatttattcactgagggttttaagattccgtggagaagatgctgagttacataatttgaaggatggaaaaagtctgtttgattttgcaaaagagtttatcgaaaacaatatggaaaattatgttgatgaagaaggcaacgaaaatatatttgcattttcagattgggatatacgtacaataattgaccaaaatagcaataagctttatactctactttatggtagaattaaatcgggcagttatggctcggagggtgaacttgtggacaaggaaacaggaaaagtaacgcacaagattacatcgaaggaggctccagttcttccgttcagcttttgtatttcggttgctgattgtgagaaagatgacggagtaacaactgccatagctatttttcagaatatcggaggaaacggagttaagactattttcgaagaacacttcaaggcgtttttaaaaaagcaagatataggtttaacactaagtttaggtgctttatatccaaaggagtttataaaagcatatatgcgagaggggaaactggctaaaataaatatgattcaatatgctattccagatgacatcgcagatcgtgtaggaatgaaccggggtgttaagagagcaaagcaaatactgacaattatgaatcctgtaggatttctgagcagaaatgagtataaaattcatgaatgcatgcaagggaaaagggcatatgataaaataatagaatttccagattttgactatgatgatttgaaatttgtttttagtatagctgggaaaaatagaactgttagtatgaagaatattgacaaaaccgttgtcgtgaaagatattacagaaattgtatcaaagataggcgggaatccagaaaaagaatcaatcattgtattgtttgaagagtattcacgggaatatctttctgatatgggacttataacgcttcaagaaaacatggaatataaaatgatggtgaaggaaaataattcgaataaagaggtgaaagcaaatgaaactattattgaggggggtgagtgatcccactatttggattttactatgttttctagtgctttttatctcaaaagtaatttttaaatcgaattactttaatataactaatattattgttaaccatgtagatgcatttagaaatgaaaaggataataaatttaataaacctcaatttgtaatagcctttattgtgcctgttttttttgcgggagcttttgcaaagattagaatagtagatgaagacactataaatattcttacattaataatttctgttttaacttcaatgttctttactttattagcgatagtgatagatattaaagcaagatggaaagagaataaaggaaataaaagctcttctgaaatgagcgtaatagggagaatattgcagacggtttattatgcggtcatgtttgagatattactttctataatactactcatattgtgttttgtagcagtatttactgcaaaattttcatttctgcaaagcattttgatatattggttttcaaatatgcttataatgaatttgtttatggtgttaaaaaggatatttatagtgatagatagaacattaaagtagatatattatagctagaaccaggagccacccacccgtggctctttttctatacccaaaacaacacgaaatgaggtgagaaacatggcccgagcgccagatccacgaattgagcaggcgaaggccatgtacctggaaggcaggaaattagttgagattgcaagtcaactaaatttgccagaggggacggtccgccgctggaagtgtacacacaaatgggacaacgaacgttcggataagaaaagcgaacgttcgcaaagaaagaagggaggccagcccggtaaccagaacgctgttgggaatgaaggtggcgcccctgacctaaataagaacgcagaaaaatacggtttcttttcgaaatatcttccggaggagaccgtttccatcatccaggagatgcccacggacccgctggacattctctgggaccaggtacagatagcctatgccgccatcatccgggcacagtccatcatgtatgtgagggaccagaaggacgtgaccatcactaagataggccataagaatggggagacggtcacagaggagcgccgggaagtacagcaggcctgggataagcatggcaatttcctgcaggcgcaggccagagcccagaagacgctggaagggctcatcaagcaatatgacgagctcctgcacaagaactgggaactggccggcgaggagcaaaaagcaagaattgcacagctccgggcccagacggataagttaactgggaacaaccaggagctggaggacatggaggggatagagggggatatctatggcggcagtaaatagttttgtcaggaaaaagaccatcccattcaacttttccgagaagcacaaggattatatacgtaggtgcgaggcctgcatgtataacgtggcggagggtgcggtccgtgccggcaagacagtggataacgtgtttgccttcgcccatgagtttaaaaccacaccggaccggattcacctggctaccggttccactatggccaatgcgaagcttaacattggtgatgccaatggctttgggcttgagtggatattccgggggcaatgccactgggggaagtacaaagacaatgaggcgctgtttatcaagggcccggacacaaggggaaaacagaagatagtaatctttgcgggagccgccaaggaagatagctacaagaagattcgtggaaactcctacggtatgtggattgcaactgagattaacctgcatcacgataacaccatcaaggaggcattcaaccgtcagctggctgcccggcgcctgaaggtgttctgggacctgaaccctgataacccaagggcgcccatctatgcggagtatatagacaagtatcagcgacaggcggatgcaggggacttcccgggtggatacaactacatgcactgtaccatctacgacaacatcaacatcaccccggagcgtctgcgggaggtcgaaagccggtatgataaaaacagtatctggtacctccgggacatcaagggaatgcgcgtggtggccaatggcctcatctaccgccggtttgctgacgacacaagtaccaggcagtacgcgttccgcctgacagataagcccaaagacatcatggagattatccttggcattgacttcggcggcagtggttccggccatgccttcacggccacggccatcaccaggggataccataacgtggttgcactggcatcagaatggattggttgcaaggatgagaaggggaaccagatagagattgaccccgaaatgctggggacaatgttctgtaacttctgccagaagataatcagcaggcacgggtacatcacaacagtgtatgcagacagcgcagagcagacgctgatagctggcatccggagcagcctgcgtaaacatggacttgggtgggtccgtgtagagaatgccctgaaaactgaaatcaatgacaggattaacgctaccgccatcctgatggcccaggggcgtttttattatgtccagggcgagtgccagagccttgtggatgcattgagtactgcagtgtgggacccaaaggaattgacgaagaatgtccggttagatgatggtacaagcgatattgacagcctggacagctttgagtatacgtttgaacggcagattagcaggctcataaagtatggataggaggtgatgggacgatgagattcacaaagatgctggacttaatcacgaatgtcctgaataaggatgcggacacgcaggtggatgtgtgcctgacatcccggatggcgaaccagatagagctgtggacccggatgtatgagaaccggtccccctgggtgaacaacaaggatgtgttcagtgcaaacctggcaccggctatcgcgtcggagctggcccgactggtgacactagaaatgaaatcagaaatcacaggtgggaatgactccgggtatctggatgaacaatataagcgaaaagtcctgaaaagtatacggcggtatgttgaatatggatgtgccaagggcggcctggtcatgaagccgtatatcacccaacacggtatcgaagtgcagttcgttcaggccgattgcttcttccctatctcattcgatagttccagccggattacacagtgcgtatttacggaacagtttcggaaaggaaagaagatatatacccgattagagattcactccatgcaggccgggagaatccggattataaaccgggcattcgtggctaccaacgactacagccttggtagcgaagtgtcagtcaacagcattgaccgatggtcagaactggcaccggaggtcacattggaaggggcggaccgtctgctgtttggatattttaaggtaccgcttgcgaatgctgacgattccgacagtccgcttggtgtatcggtgtattctcgggcgattggcctgattaatgaggcagacaaacgatattcgaacatctgctgggaatacgaaggcacacagcttgcggtacacatcgcgacgtcgctgcttaagtacaaccgggatcgtgataaatttgaataccccggaggaaaggagcgcctataccggaatctggaatataacacgggtgctgctgataaaccattcattgataccttttctcctgaaatccgagacactgcgctgttcaatggctttaataatcagctgaaattagtggaatttaactgctgcctggcatatggaacgttgtctgacccgcaaagcgtggacaagacagccacggaaatcaagaccagcaagcagcgatcctacgtgatggtatcagacacgcagatggcattgcaagatgcgttagaggatctggtgtatgcgatgcgcttttgggcggaactttatggattagttccagccggtggaaactacgaggtgtcttttgactgggatgacagcgtcatagtagataccgaagaagaccgaaatcaggatcgtaatgacgtggcgatgggagtcatgaggctggatgagtaccgcgctaagtggtatggggaaacgctggaagaggcggccaagaacctgccggaaccggcactgacggaggagtgatgtaaatgacgccagaagagctggagaagctgccaaaaccgattgagcgaaccatgacaaccctggagctgtcaattatgaatgagattgtacagcgcatcaaggcatccgcacagattactccggtaacggactggatgttgaaccgacttaccgcaatcggcgttagtaagtccaaaatcaaacggatgattgaggaggccatcaaacaagctggactgcaggtggatgatatctacaagcaggctgctcgatctgattacatccgcaaccgagagatatatgaggctgccggtgttgactatcagccatatgaggacaaccaatggctgcagcaggttgtggatgctgccaggcggcagaccaaggacagcttgaggccattggaaaatatcacccagacaacgggttttaatgtgccgatgggcggtggaaagaaagtatttacgccactgtccgaatatctggagcgcagcctggataaggcaatgcttggaatcactaccggcaccaggacgtacagccaggccataggtgaggtgattgacgagatgacggccagcggcatccggactgtggattatgcatccgggaagtcagaccgcatagaggtggcagccaggcgtgcagtgatgaccggtgtggcccagatgaccaaacaggtcagcgacaagaacgctgaggagctggggacggaccattgggaggtagactggcacatgggcgccaggaacacaggtactgggtaccttaatcaccagagctggcaaggcaaggtatacagttctgaggagatgcggactgtctgcggcgagggtgagatgctaggtttcgcaggcattaactgctatcatattaagttccccttcctgcctgggatatcaaagcggaagtatacggatgagtggttggcggaacagaaccggaaagagaatgagaagaaaacattccgggggaaggagtatgacacctatagcgcattgcagtatcagcggaagttagagcgaaccatccggaagcagaaacaggacgtggaactcctggagaaggcgggagctgataaggatgatataacggctgccaagtgtcggttgagactgaccaataaggcttatgtggatttctctaaggagatggacatgcggcaacagagggagcggctgaggattccaaagtaaaaagttgcgatatcgcaacggaaagagaggattatatgattattacaggaatgaagcattttgaaaatgtatgccagaagaaattggttgagtggtatagaaaaaatagaccaggggttgaaattgacttgggcgatgtatttattgtttggtcatgcaagactttacagaattataagtgtcttgcatctacgacaataagcggagatggaatctatgctgaatatacgtttaacggcgataagcaagaattgtatgaagatgtgtacaagaaactgacaaatatttgccacaaagaggagtaagcacgcgggactaccctgggtgctatttttacgcccaaaattgcccggaacggcgtaaaactaccaccacaagggatgcaaccccgtagaaaagcgtagtgagaaaggagcaatatgaaacgtaaatttttagaggacatgggcctggcgaaagagcaggtagacagcattatggccgagaatggcaatgatatcgaggccatcaaacaggagcgggatacttacaaggggcagctggagacggcgcagtcaacgctgaaaagctttgagggcgtaaatatatcagagctgcaaacgaaagtgacaacgcttacaaacgaccttgcaaccagagaggcagagtataaaaagcagttggcagaccgagactttaatgacttgctgaaatccacggcggaaggatttaagcctagggatatcagagctgttatgcctttcctggacgtggaaaaactgaaatccagcaagaaccaggaaagtgatatcaaagcggccttagaggctgtaaaaaaggacaacgggtacctttttcaggatgtcacaattccgagagtggttgcacccactccggggcctggcggagaaaaaacagacgatacaaggacacaagcaaacaatgccctgagaagtatcttgggcagagaataaggaggtaaacaatatatggcagtatatattacaagcagagccgacgcggaggccattatccgcgaacaggttatttcaactatttttcaggacgcaccgaagcagtccacattcatgagcatggcgcgtaagctgccgaatatgaccagcaaccagacccgcatgagggttcttgacttcctgccaacggcttattgggtggatggggatacaggaatgaagcagaccagccgccaggcatgggacaacgtattcatcgaagccgccgagctggcagttattgtgccgattccggaggctgtgctggacgatgcggagttcgacattttcggggagattactccaagagtcaacgaggcgatcggccagcgagtggacagcgctattattttcggtgtgaaccgtccgcgtaactggcagaacgatattatcacactggccagacaggcgggaaataatgtggcagtcggatccaatccagattattacaatctgctcctgggcgaaggaggcgttatttccaaagtcgaggaggacggctttatggcaaccggagctttggctgccatgagtatgagggccaagctgagggggatccgcgcaacggacggcagcctgatttttaaatccgatatgcagggttcaacaaactatgcgttggatggggcaccgatgtacttccctcagaatggtgcttatgacaatactatcgctcagctgattgttggtgacttcaagcaggcggtatattccatccgtcaggatgtgacggtaaagattctggaccagggtgtcattcaggacccgactacgaaagaaatcgtctataacctggcacagcaggatatggttgcactgcgtatcgtattccgtatgggatgggcgcttccaaacccggcaaccaggatggacgaagaccgtgtaggctgcccgtttgcttacctggaaccgtctacagcggtaacaacccagaaagttacatttacagtaaaagacaaagatgaatcatctacagcaattgcaggcgcgattgtagacgtaaatggatctagaattaaaactaatacatcaggtgtggcagaatttaaccttcgcgcgggaacatatccagcgaagattaagaagactggatatggcacaatcactgagactgtaactgtggaagcagcaccagtggaaaagacggttacactgattaagcagtagaaaggaaggtgtgctgatgacttatgccaatgaaacattttacagagaaagctatctcctgggacggaagccagtcatcagcaccggcttcctattttacgcccgtcaggccagtcggttgattgaccagtacacatttaaccgcctgaaagatgcgtcagaggcttcggaagaagtacagatgtgttgttgtgaactagccgaggcagaattccgcagggagaggcagctgaaagaatctggcgggaaggctgccgagaggattggaacctactctgtcagcttcggttccgctcaggagttagctgcagcttccggccgggaacagcgggaaatcatcatgaagtggctggctgataccggtctgtgttatcagggggtgtaatatgtataccaacgcagattgcacgctgtatctgtacagcaaggaaggaaagaacgagaaatacaccaggttccctgttggaggagtgtactgggaggatgtggagcaggccaccttcctgaagaccggacagcggaacgcctgctccgtacttctggttattcctctggaaagcctgtctgagccggttaatttcacgaggggaaaagaccttgttatcaagggaattgttacagacgagattgactgtaacagccaggaggccatgtcaaagtcactggcggccttaaaagcagcgcatgagctgctaacggtaactacggtagatgagcggttgtatggcagcgagtcgatgcagcattatgggctgtcctgtaagtaaggaggcggcgaggtgtttaacggaagtctggagcttaaatcaacaaactttatcctgaaaaaccacggaatccagccaggcggaccagtgcagaaggtgatagacagcgagactatgcggtatatgggtgattatatgccgcgccgtcaggcaggagaattggaacacatgatggtactgtccaccgtcatcggctccggacagatagacattccgggaccatatgcccattatttgcacaaaggtatattgtacgtgtctccgacgacaggcagctcctgggcaaagaagaatgaaattaaagtaccggcggagcgagagctgacttatgcaggcgcgccgatgcgaggcaaggaattcttcgaacgcatgaaagccgaccatagggaagatatcatccaagcggcgcaggcattgatagacagaggagggaagtaattgacaatcatagattttatgaggcagaaactgacggaatatccgaaaatatcagagtttctggctggcgatgacattcacatcgacttcacggacccttcccccgtcaattatggcctgtccagtaccggagacagcctggtcaaggaggatttgctgggaaaccagatacggcagcataattttgtcatgtatgcggttggccaatcatttacggattataaccggttggccaacagtaattttctcctggagctggcttactggctagaacgactgccggaagaggaaggcatatccggcacggtggagaatcgggagtttctggggaaatttatgaaagtgtccacggccaatgccatgagcatgggactgatgggagaaaccatagagcagggcgtcatgtatcagatacagatatacgcccaatacaaaatagaaagtgaggaattataaatgccggatgtaacgggtaaaatcaaacgaaaatttatggcacattatattgattctgcgcttccatcggctagtaaagccgaatattcccgaccatcgggtcaacttgctcccgaacttttacaactaaatatccgccgcccacaaagcggcacaccaagcaggaaatctgaaaaaggttgcctgctttttttctgcccaaaatgaggtggtaaaacgccaccccatccataaatcaaggaaaggagggacacgaaatgccctgtccacacaacgaaatttctattgtgcagcgaagccaactgcagtctgcggttgccgccgctgcttaccaaagcggcgaaaagctgttctgtgaatacgaccagcaagtgaagcactactcggaaaagcgtggtatcgtccacaatgaaatcctgtttccggcaaatgccccaccggagtatgcagaccgcaataccctatggaacgccgccgaagcggtggagaagcaatggaactcccagcttgcaaggcggtgggtgcttaccatccccaaagagataccgcccgaccagtatgctgtccttgtccgggagttttgtgagcagcagtttgtttccaaaggcatgattgctgactttgccatccatgacccccatccgccgggacacaatccccacgcccatgtcctgctcactatgagggcaatggacgaacatggaaaatggcttcccaagagccgcaaagtttatgaccttaacgagaacggggaacggataaagctgccatccggcaggtggaaaagccacaaggaggatacggtggactggaacgaccagaagtattgtgaaatctggcggcatgaatgggaggtcatccagaaccgctatctggaagccaatgaccgcccggagcgtgtggacttgcgttcctatgccagacaggggcttgatatagtccctactgtccatgagggagctgctgtccggcagatggaaaagcggggtatccagacgaatatcggaaacctgaaccgggaaatcagagctgccaacaatctgatgaagtccatccggcagcttatccaaaacctcaaaggctggattaccgagctgggcgaaaaacggaaagagctgcttgcacaaaaggcggcggaggaagcaacacttcttcccaatctgctgatgaagtatatggcgatacgaaaggaagaacggaaggactggacgagggctgggcagaaccgggggacttccaaagacttaaaggcagtcagcgaagccctgtcctatctccggcaaaaggggctttccactgtggaggacttagaagcgtttctggaatcttccgggaaatcagccgcagattaccgcaatcagatgaagccaaaggaagcccgaagcaaagtgattgacgggattcttgccagccggacagactgcaaagaatgtaagcctgtctatgagaagtaccagaagatattttttaagaaaacaaaggagaaattcaaacaggaacacccagaggttgcccggtatgagaaagccaccgcctaccttgccaagcacccggacgataaggacagcacccaaaaggagctgcaagaggagcaggaaacgcttctcagcgacatcgcagagctgaaagtaccactgaccgaggtgcaggaggatttgaagaagctgcgggacatccgctactgggtacggaaagccacacccggcacagaggaaagtaaagagccgcccaagaaacagcctatcaaagaagtcttgcaggataaggctgacgagaaaaaagcacaaagaactgtcccggcacagacgaaacacaaacaacagggtatggaactttaacaggcacttgccattttcaatcagagaatgtcaggtgcttttcttattttcaaggagggatagatttgaatgtatttgaagctgtgaagcagtccgtcacaacaagacaggctgcggagcattatggaatccatgtaggtcggaacgggatggcttgctgcccgttccataacgataaaaccccaagcatgaagctggatcggcgttaccactgcttcggctgcggtgtggatggggatgtgattgattttgccgccgccctgtatgggctgggaaagaaagaagccgccgtacagctggcacaggacttcgggctttcctatgaggactggaaaccgccgggaaaggcaaaaaagcccaagccccggcagaaatccccggaggaacagtttcaggaagcaaaaaaccgctgcttccgtattattaccgattatcttcacttgcttatggcatggagaacggactacgccccgcactccccggaggaagcctttcatccccggtttgtggaagccttacagaagcaagaccaagtggaatatctgctggatgtgctgctgttcggggagacagaggaaaaagcggctttgattacggactacggaaaggatgtgatacagcttgaacagcgaatggcagagcttgcagccgcagacgcagcaggaactaaaaaacaccatgaacgccatgcagccgccccagagcattgaggaaatcaaggcggggctggaaaccaccgagaaaggcggtgtccgtcagagcatccggaactgcctgaccgtattccagcgtgacccgctgctttccggggctatcgcatacaacatcctaactgaccgcaaggacatcataaagcccatcggcttccacagagaaagcaccgccctgaatgatacggatatgaagtatctgcttctctatctggaagaaacctacgggcttaccaatgagaaaaagattgataacgccatcgggattgtggcgaatgaaaacaagtaccatcccatccgggactacctaagtgcccttgtgtgggacgggacagaacgaatccgtttctgtctgcggcactttctgggggctgacgcagacgattacacctatgaagcgttgaagctgttcctgctgggtgcaatctcacgagcctttcagccggggtgtaagtttgaaatcatgctctgtctggtaggcggtcagggggctggcaagtccaccttcttccgtctgctggcagtccgggacgagtggttctccgatgatttgcggaagctggacgatgacaatgtgtaccgcaagctgcaaggtcactggattatcgaaatgtcggaaatgatggcaaccgccaacgccaagagcatcgaagaaatcaagtcatttttaagccggcagaaagaggtttacaagataccttatgaaacccacccggcagaccgcccccgtcagtgcgtgtttggcggcacttccaatgcccttgacttcctgccccttgaccgttccggcaaccgccgctttatcccggtcatggtgtacccggagcaagccgaggttcacattttggaggacgaagctgcttccagagcctatatcgagcagatgtgggcggaagcgatggagatttataaaagcggcagattcaagctggctttcagccctgccatgcagcgctatctcaaagaacaccagcgggattttatgccggaggacaccaaagccgggatgatacaggcgtatcttgataagtacaccgggaacatggtctgctccaagcagctctacaaggaagccttaaaccatgcttttgacgagccgaagcaatgggaaatccgggaaatcaacgagattatgaaccagtgcattgaccgctggcggtatttcccgaacccaagaatgttttccgaatatggcagacaaaagggctgggagcgtgaaaacccggcaacggactccggcaacccgtctgaaaaaacgatggacggttttgtggaggtcacagaacagatggagcttccattctgaaaatgacagcccgttgcaccccctgttgctatcccgttgccgagccggttgccggggaaaatcccataactgcgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgttacaacggtgtttgacggggaactggacgccactgatgtgttcgtcagcctgatttcccagaaatacggcaagacaaatacaaaagaatatcttgctaaaaagaaagatttgaagtataatgaagatgaggttcaaaagagccagataccgtctggattgtgtgggtaaatggctatgatgaacgaaatggaatacagaacaatcggttcggcacttgccgggggctatcgtgcagcggtctattgcaggctgtcaaaggacgatgacctgcaaggcgaaagtgccagtatcgcaaaccagcgtgatatgctggaaaaatactgcgaaaagcagggatgggaggttgtggcagtctatcaggatgatggcttcacaggtcttaatatggagcgtcctgatttacagaggatgttgagagccattgagcgcaggcaaatcaaccttgtcatcacgaaagacctcagccgactggggcgtaactatctgcaaaccgggcatttgattgaggactttttcccaagaaacggtgtccgctatattgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttctccgttatcaaagaccttttgatgaatcccgtctacaccggggcgattgcttcccagaaaaaagactaccgtttcaaaatcggcacgattggggaaaagaagccggaggactggattgtggtggaggggcagcatgaaccgctgattgaccgcatgagctttgacattgtgcagaataagctgaaatcccgccagcgtccggggcagaccaatgaaatcagcctgtttgccggactgataaaatgcggcgagtgtgggaagtcgctgacggtacgctacacaaacgcaaaacatccccagcagatttattcctgcaagacctacaatgcctttggaaagaaccactgcacccagcaccggattgactatgacaccctttacagccatgtgctgcggaaaatccgggaatgtgccagagctgccctgatggacggggaagcggttgccgaccgcctgaccaatacctgtgaagccgagcagcgggaacagcgggaagcaatggaacgctcccttacaagggacgaggaacggattgaggttctggacaaaatggtcatgcggctttatgaggatatgattgcagggcgtatcagtgagcagaatttcaacaccatgctggaaaagacacagaccgagcagacggagcttaaaacaaaagtgtccgagggcagaaagcggctgtccgatgaagtccagcttgccaatgacgcaaaacaatgggtggaagccattcaggaatatgccaacatcacagagctggacgcagccaccctcaaccgcttaatcaaagaaatcgtcgtgcatgaacgcattgacgaagataaaacaagacacatttctatcgaaattcattttaatctcaaacctatcccggaggtggaacaggtcactgcctgacctgtcccgccgggacggttctcttaaaaacaccatatagattttttgtacgccgccgcccgccatcgagcagagttttacacctaattggggataaaacagctcatggccggtgctggtgtagccgtggtaggcatggtccttgtacctctgctctccgggcttttctctgtctaagcgtctccgtatgaaatccttgccgctcccgcagttttgcgggggcggcggaaaggaggttgacaccgtatggatttcttacttgaagccctgacaaattggctgaaagaaatgctggtgggcggcattatgagcaacctttcggggatgtttgacagtgtaaaccagcaggtcgcggatatatccgtacaggtaggccagaccccacagggatggaatggcagtattttcagcatgattgagaatctgtccaactccatcatggtgccgattgcaggcgtgatcctggctatcgtgatgaccgtagacctgatccagatgatcgcagacaagaacaacctgcatgatgtggacacctggatgattttcaagtgggtgttcaaatcagccgctgccatcctcattgtcacaaatacatggaatatcgtgatgggcgtctttgatatggcgcagagcgtagtggcgcaggcggcaggggttatcaattcggatgcgtccattgacatttcctcagttatgaccgatctggaaccgaggctgatggaaatggatctgggaccgctgttcggactgtggttccaatccctctttattggcattactatgtgggcgttatatatctgtatctttatcgttatttatggccgtatgatcgaaatctaccttgtgacttcggtggctcccgttccaatggctgcaatgatgggtaaagaatggggcggtatgggacagaattacctccgatccctgctggcgctgggctttcaggcgtttctcattatcgtctgcgtggcaatttatgctgtgctggtgcagaacatcgctctggaagatgacatcatcatggcaatctggagctgcgtgggctacaccgtactgctgtgctttacgctgttcaaaaccggcagtctcgcaaaatcagtctttcaggcgcactaaaggagggttctgtatgaaaaaatatcaaatcatttacgcagacccgccatggaactacaaagtatattccaagaaaggattgggacgcagtgcagaaagtcactatccgaccatgagtatcgaggatatttgtgcgctgccagtaggcaacttggcggataaagactgtgccttgtttttatgggtcacgattccatgtttactggaaggtctctcagttctgaaggcatggggatttacctataaaaccgtcggctttgtttgggtaaagcaaaatcgaaaggcagatagcttgttctggggaatgggatattggacgcgctccaatgtggaactttgtatcctcgcaacgaaaggacatcccaagcgtataaacgcagctgttcatcaggtcattgtctctcacattgaagaacattcaaaaaaaccgcaggaagccagagaacgcattgtctcattgatgggtgatctcccgcgcatagaactgtttgctcgtcaatccacacccggttgggatgtgtggggaaatgaagtggacagctctatttcattcccataaaggaggtggataatatggcttatgtacccgtacccaaagatttaaccaaagtcaaaaccaaggtcatgttcaatctgacacgaaggcagctggtctgctttaccgccggggcgcttgtaggtgtaccgctgttcttgtggctccgtgagcctgcgggaaacagcatggctgccatgtgtatgatgctggtcatgatgcccttcttcctgctggcaatgtatgaaaagcatggacagcccctggaaaagatcgtcggcaacatcctcaaagtagctgtgatccgtcccaagcagcgtccctaccagaccaataacttttatgccgtattaaagcggcaggaaatgctcgataaggaggtgtatgacattgttcaccgcaatgaaaagctggctgcgccgtctgctgggaaaaccggaagaaaagaccgtgcatccggtaaagacaaagaaaaagctgtcccgcgccgataagaagcagatcgaagcggccattgcccgcgccaaccgcacggacaaaaaaggaaaatcggcacaggacagtatcccctatgaacgaatgtggccggacgggatctgccgcgtatcggacagccactacacaaagaccattcagtttcaggacatcaactatcagctctcccaaaatgaagataagaccgcgatctttgagggctggtgtgatttcctcaattatttcgacagctcgattcacttccagctgtcttttttgaaccttgcggcatcggaggagacctttgccaactccatttccattccgccccagggggatgcctttgacagtatccgtgaggaatataccacgatgctgcaaaatcagctggtcagaggcaacaacggtctcatcaagaccaaatacctgacctttggtatcaacgctgacagcatcaaagccgccaagccccgtctggagcgtattgagaccgatatactcaataacttcaagcgtcttggtgtagccgccagaacattggacggtaaggaaaggctttcccagcttcatgcggtattccacatggatgaacagctcccgtttcagtttgaatgggactggctggctccttccggcctgtccacaaaggattttattgcaccaagctcctttgagttccgcaccggcaagcagttccgtatgggcaagaaatacggggctgtttcttttttgcagattttagccccagagctgaatgaccgtctgctggctgattttctggatatggaaagctcgctcattgtgagtatgcacattcagtcggtggatcaggtgaaagccatcaaaacggtaaagcgtaagattaccgatctggaccgcagtaagattgaggaacagaaaaaagcagtccgcgccggatacgacatggacatcattccttctgaccttgccacctacggcagcgaagcgaaaaagctgttgcaggatttgcagagccgaaacgagagaatgttcctggtctcctttttggtgctgaacacagcggacaccccccgtcagcttggcaacaacatctttcaggcaggctctattgcccagaagtataactgccagctgaccagactggacttccagcaggaagaagggctgatgagctgtctgcccctgggactcaatcagatcgagattcagcgagggctgaccaccagttctacggctatctttgtaccattcaccacacaggaattattccagaacggcaaggaagccctgtactacggcatcaatgccctgtccaacaacctcatcatggtggatagaaagctgctgaaaaaccccaacggcttgattttgggtacgccgggttccggtaagtctttcagcgccaagcgtgagattgccaactgctttttgcttaccaatgatgatgtcatcatctgtgacccggaagcggagtacgcacctctggtggatcgtctgcatgggcaggtcatcaagatctcgcctacctcaaccaactacatcaatccgatggatctgaacctggactattcggatgatgaaagcccactgtccctcaagtctgactttatcctcagcttgtgtgagctgatcgtgggcggtaaggacggattgcagccggtgcagaaaaccatcatcgaccgttgtgtgcgtctggtctatcagacctacctcaatgacccgcgcccggagaatatgcccatactggaggatctatataacctgctccgttcacaggaggaaaaggaagcccagtatatcgccacggcccttgaaatctatgtaaccggctccctcaatgtgttcaatcaccagagcaatgtggacatcaataaccgcattgtctgctatgacattaaggagctgggcaagcaactcaagaaaatcggtatgttggtggtccaggatcaggtgtggaaccgcgttaccattaaccgcgctgcccacaagtccacccgttattacatcgacgagatgcacctgcttttgaaggaggagcagaccgccgcttatacggtggaaatctggaagcgattccgcaaatggggcggtattccgacaggtatcacccagaatgtcaaagtgcgcccagatagggcgctgtgcaaagcagtctaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgcaggtgtgggaaaagtcctgaaacccatgtcataacgctgtcacgtcatctttcacggcgggataactgccaacacgttatgaaacaggcgtgagaacacgtcacaacgaaccgaaagcatatccgacaatcttcactaacctatgcacagtgctaactggggattgcctaagtccggctcatttgccggatatggtaacggaggctccatagtagtccgagaggggtaatgacccttacatggcgaagggagccagttagtaacatctaaaatgtaagaatgaaagggaggagaaacctcaatgaaaccaacatctgaaattttagagcgtattgaaaagtgttccagcgaacacaaagacggcgtattcacaagactttacagatacttgcttcgtgaagatatttactacgccgcctatcagaaactttatgcaaacaaaggtgcaacaacacagggtatcgacgacgataccgcagacggtttcagtgacttctatataaaagagttaatccagtcactaaaggacggaacctacaaggctaatcctgtaaggcgtgagtatattccaaagaaaaatggaaaactccgtccgctgggtatcccgtctttccgtgacaagctcctgcaagaagttgtcagaatgattttggaagctatctatgaacctgtctttgacagtcattcccacggtttcagaccgggcaaaagctgtcataccgcactgcgtcagatttcttctgacttcacaggcgtggtctggtttatcgagggcgatatacaaggttgttttgataacatcaatcacgaaaaattgattgagattttgagcaggaaaatcaaggacagtcgttttctgaacatcattcgccagtttttgaaagctgggtatatcgagaattggaagtacaacgccacttacagcggttctccgcagggtggtatctgttccccgatacttgcaaatatctatctgaatgagctggacaagaagtttcgggaaatcgcagaactctttgataagccgaggtctgcatatcagacactggaatatcatgcggcaagcaaagaattaaaaagactgtcttactggattgaccatacctctgatgaagcggcaagacaagaactgattgaccagcatagggcgcagaagaaagctatgagaaatctgccctgcaaacctgccgacaacaagaagtttacttttgtccgttatgcggacgattggctggcaggcgtgtgtggcacaaaaacggaatgtgaggaattgaaagccgaaatcgctgaatttctaagcacagagctgaaattaactctgagcgaggaaaagacgctgataacgcacagctccgaaaaagtccgcttcattggctatgatatttgtgtccgcagaaatcaggaagtcaaaggtcacagaatgaaaaacggaacgtggagaaaatcccgtaccctgcacatgaaagttgccttgtctattccccatacggaaaagattgaaaaattcatgtttgcaaagaaagtcattcgccaaaaggaaaacggggagtttcagccgatacaccgagccggacttctcaaccttgcggattatgaaattgtggaacagtacaatgccgaagcaagagggttatgcaactattacaatctggcttgtgattatcacacgttggactacttctgctatctcatggagtacagttgcttaaaaacgattgctaataagcataaaaccagtatccgcaaaatcattcgccagtataaagacgggaaaacatggtctgttccttatgaaaccaaaacagggacaaagcgtgtgcgccccgttaaaatcgctgactgtaagcgtggcgaagcgagtgacatcatctatcagagaaagaaatttagctggaaaaccactatcagacagcggctcaatgccagagtttgtgaattatgtgggtgtaaagaagccgatttgtatgaggttcacgttatacggaacttaaacgaattgggtaattctgattgggaaaccgtgatgaaaaagaagcggagaaaaacgcttgtcgtttgcagcaagtgccatgaaagaatacacagacactaatcaatacgtcaattactaatggggagccggatactttgagaggagtaagtccggttccgagggagggtgtaggaaacctaccgccagcggcggcaaggcgcctttaccctaccctacgaccttttgagcagccgcgaggtggagaacatctttgaaaactccgacttcgtgtatatgctcaaccaggcaggcggagaccgtcagattctcgccaagcagctgggcatttccacgcaccagcttagctatgtgacccactccggtgagggcgagggcctgctgttctatggctccaccatcctgcccttcgttgaccacttcccgaagaatactgagctttaccgcattatgaccaccaaaccccaggaactgaaaaaggaggatgaataactatgaaacagaatatttgcgaacttgataccatgatttttttccgtgaggcattggaggctcacgaattcatgttgcttccggtaatggcctccgctgttgttgagtgtcgtaccgctgacaaagaactcaaaaccttgaatgaggatggcgaaattggtcttgcccgtctcttttcgatttgggcgaatatgatgtgtgcctctggtgcagcaaccattgtagggtgcagacctatcacaatgctctctgagattctggcgcaagtccatgcgtatctcaccgtgcatccgctatatgatccggaaggtttggccctctatgtggagctgcaccacatgatggatgctatcctaatgggtgattggtttgaataaagagccgcgcctgcgctttactgatgaggaacgggctgaccctgcactggaaaagccgatccgcaaaacggagaaagctacggccagagcagataaggcgcaggccaatattccaaagaaaaaagtcagacagacggtcattgacccggacaccgggaaaaagacctcgaagctgacctttgaggacaagaaaaaaccaccttccaaactttctcaaggggttaaggaagctcccgtccatctggtcgcgggcaagtttcacaaagagatccgggaaacagaacaggacaatgtgggcgtggaaagcgcccacaagtccgaggaggcggtggagaccagcgcttatctggtgcgggagggctatcgcagccacaagctgaagccgtaccgcaaagcagcccaggccgagcagaagctggaaaaggcaaatgtaaatgccctgtaccagaagtccctacgggaaaatcctcagtttaccagcaaccctctctcccgctggcagcaaaaacagagtatcaaaaagcagtatgccgtcgccaagcgcaccggtcagactgccggaaataccgcccaggctgcgtccaaaaccggaaaagccgcaaggacggtaaaagaaaaggcacagcaggcaggggcattcgtcatgcgccacaagaagggcttcctgatggcaggggtttttttcctcatcgcctgtatgctgatgaataccatgtcctcctgctctatgatggcacagagtattggttctgtaatttccggcactacctatccatcggatgacccggaaatgctggcggtggaggcagattatgcagacagagaagctcggttgcaggagaaaatcgacaacatcgaaagcagccacccagggtatgacgagtatcgctataaccttggcatgatcggccatgacccccatgagcttgcggcgtttctctctgctgtcttgcagggctatacacgccacagcgcacaggcagagctggagcgtgtgtttgatgcacagtatcagctcacgctgagagaagaaattcagattcgcacttacactgacgaagatggggatgagcatgaatatgaatatcgtattctccatgtaactttaacaagccgttccattgcctctcttgcgccagaactactgactccggagcagatggagatgtaccaggtctaccgacagactatgggcaataagccgctgttgtttggtggcggttctcccgatacaggtgtttctgaagatttgactggtgttgaatttatcaatggcacccgccccggcaatccgcagctggtggaactggcgaaaagtcaggtgggcaatgtgggaggacaaccttattggagctggtacggctttgactcccgtgtggaatggtgtgcctgctttgtatcatggtgctatggtcaatccggtcgaacggaaccacgctttgctggttgtcagtctcagggtgttccgtggttccagtctcatggacagtggggcgcacgaggatatgaaaacatcgcccccggtgatgccattttcttcgattgggatctggatggttccgcagaccatgtgggaattgttgtcggcaccgatggcagccgtgtttataccgtggagggaaattccggcgatgcctgcaagatcaaaagttatgacctgaattatcagagtatcaagggctacggcctgatgaactggtaacagagattttttagaaggagtgatagacgatggcaaagaacaaaattgaacgcattgaccaggagattactaaggtccgcgagaagatcgcagagtatcaggaaaagctcaaggcgctggagacacagaaaaccgaggcagaaaatctggagatcgtccagatggtgcgcgcactgcgtatgaccccggctcagctgagcgccatgctgtccggaggcacagttcccggcagtttggctgatgacaacaacgaacaggaggaaaacagctatgaggaataaacgattgctccgaacactttccgccatttgcctgacgctggttctggcattgggctttaccgttcccgcttttgcccagggcgcagctccgcccccggcagaggataccaccaatgacagcaatgtggtggtggaagaaacggaaaaagcacctccgctgaccccggatggcaacgccgctctggtggatgattttggtggcaacaagcagctcattaccgttaccaccaaggcaggcaactatttttatatcctgatcgacagggccaacgaggataaaaagactgctgttcactttctgaaccaggtggatgaagcggacctgatggcgctgatggaagatggaaaacccaaagaggagccgcctgctgtgtgcagctgcacgaagaaatgtgaagcaggggcagttaatacggcctgtccggtctgtgtaactgataagagtaaatgtacgggaaaagcaccggaacctccggcagaaacaccggagccggaaaaagagaagcctgccggactgaacccggctgcgctgatccttctgctggctctgctgggcggcggtggcgtatttgcctacttgaagctcgttaagaataagcctaagaccaagggcaatgacagtctggacgattatgattatggcgaggaagattccgaggaatgggaaaccgaagatgaggaagtccttgaggatggttttgagggttctgaccctaatgaggaacgcgatagagcagattgaaccatttgagcgtagcgtatttcaaatcattgcgggataagggacagaggacagggagaaattcctgtcctctgctgctctactcactctcttactgtaaatccacacccaaaatcagcacatggtcaaagaaaggaggacctcacaatgaacacatggaactggttattacactttctgattatttttgatctggtcgccttcggaatttactttggaggagacattcttttcactgctatcagcaaagttcaaaaaaagtcaaagaaggacgatgacttggatctttatgattttgaaattgagaccgcaccccaaaagcgctctttatgtgtggactcaatccgaatgctttattctggtgagatagatgaatttgtggaaaaggaactgttgcctgatgcagcggagaccatgaacgctttatctgaagctgaaaaaacagcagttagcctgttactaaaagcttatatcggttttttgagcgaagaagcaacggtagatgaacaaagttttcccatggttaaggaactgttgtcttatacacagggcagcaaagaagatggtgaaaaagatgccatagattgtctgatggaagatacggtcagcagaacccacagacatcgagaatattacaacaattatcaacgctatcaactgatgcaggtggataaagagcgtgtgattatggcctgcaatatcataatcaatgatttgattggcaggttgtaccgatatgattatcgctttggctatgacattacacttgcctcagaacacagcattgcaaaaaaactgtctgataattggcagaatgaatgggaggctgaagatgatgagatataaactggtaatcgctgaaaaaccatcggttgcacaaagtctggctgcggtaatcggtgcaactgctcgtaaggatgggtatctggagggtaacggctggcgtgtcagctggtgcgtgggccatctggctggtcttgcggatgcagacagttatgatcccaagtatgccaagtggcgatatgatgacctgcctatcctgccggagcattggcagatggtggtgggaaaggataagaaaaagcagtttgatattctcaaaaagctgatgaacgccccagatgtgaccgaagtggtaaatgcctgcgatgccggacgcgagggcgagctgatcttccgcagcgtctatgagctggcaggctgccaaaagccgatgaaaaggctctggatttcttcaatggaggactccgccataagggagggctttgcaaacctgcgtccaggtgtagattatgatggacttcggaaagctgctctctgccgtgccaaggccgactggctggtagggatcaatgccacaaggcttttttccgtgctgtaccaccgcaccctcaacatcgggcgcgtgatgtccccaacgctggcactcattgtccagcgagaagctgaaatcgacacatttaagccggttcctttttataccgtggcgctggagctgcccggtcttaccgtatccggggagcgcataagtgaccgagcaagcgcagagcagctgaaagaagcttgccaggatgcagctgtcacaatcaaaaaggtggagtgcaaggaaaagtctgaaaagccgcctgccctctatgatctgactactctgcaaagagatgccaatcgcctgcttggatttacagcccagcagaccctggactatctgcaaagcctgtatgaaaagaagctctgcacctatccccgtactgacagccgctatctgaccagtgatatggcagacagcctgccggtgctggtgaatctggttgccaatgctatgccgtttcgcaaagggatcgccattacctgtgatccgcagacggtcatcaacgataagaaagtaaccgaccaccacgcagtaattcccacccgaaatctcaaggatgcagacctttctgcccttcctgcgggagaaaaagcagtgctggagctggtggccctgcgtctgctgtgcgccgtggcccagccccatatctattcggaaaccgttgtgattgcagcgtgtgccggtggggaatttaccaccaaagaaaaaatggtgaggcaccccggatggaaagcactggaggacgcttaccgtgccaaaacgaaggatgcagagccgaaaaaagagggtgcagagaaagccgtgccagagctgactgaaggacagaccctttcggtttctgcggcaatcgtcaaagaaggcaaaagcagtccgccccagcactttacggaggacaccctgttgtccgcgatggagactgccggaaaagaggatatgccggaggatgccgagcgaaaaggtctggggacaccggccactcgtgccggtattttggaaaagctggtatctgccggttttctggaacgaaaaaagagcaggaaaacggtgcagcttctcccttcccacgatgcagtctccctgatcacagtcttgccggaacagctgcaatcgccgcttctgactgccgagtgggagtaccgcctgggagagatcgagcgcgggcagcttgccccggaggagtttctggacgggatcagcaccatgctgaaagatctggtgggaacttatcaggtcatcaagggaaccgagtacctgttcactccgccccgtgaggtggtgggcaaatgcccccgctgcggcggtgaagttgcagaattgcaaaaaggcttcttctgtcagaacaaagattgcaaatttgcaatctggaaaaacaacaaatggtgggctgccaagaaaaaacagccgaccaaggctgtggtgtctgcactgctgaaagatggccgtgtccgtgtgacgggcctatattcggagaaaaccggaaagacctacgatgccgctgtggttttggaggatgatggacagtacgctaacttcaagctggaatttgaccagcggaaaggaggcagccgatgaagctctctttagcggaacgggaaaccattctcctctataaccaggcagaaccaatggctgaggtctacacccatgatccccgtctgatggagaagctggaactgctggcaaaaaagcaccccgaccagattacccgaaaggacgcccataactttaccgtccccaagcggtgtgtatcagtcagggagccatacagcgcagaacgccgcaaagccgccagtgagcgtgcgaaagccgccggataccagccccctgtgagaaagtccagcagttaatggcacatggcagagaatgtgtttgaagcagtcaagcagtcggtcagcaccagagaagcggcagagttttacgggataaaagtcagtcgaactggcatggcctgctgtccctttcacgatgataagaaccccagcatgaagctgaacgaggaatatttctactgtttcggctgcggagctactggcgatgtgatcgactttactgcaaagctctttgacctctccccaaaagaagcggcggagaaactggcacaggactttggcctgatctatgacagtcaggcccctccccgcaggaggtatgtccggcagaaaaccgaggcacagcagtttcgtgaggatcggcagcggtgttatcgcgtactgtccgattactaccatctgctgaaaaaatgggagagcgaccattctccccggacaccggaggagaaaccgcacccccgctttgtggaagcaatccataagaaaatctatgtggagtacctgctggatctttttctttatgaaagtgaagaagaacaaaaggcatggattgcagaacacacagcagaaatcacacacttggaaaggagattgaaaatcatggctgagaacaaacccaccaaccgagagcggctaagggaaatcacagacggcatcgagcagggcatcaaggaactgtttgagagtgaaaagtatatgcgctatctgtccgttatgtcccgcttccaccgctattcggtaaacaacaccatgctcatctatatgcagaagccggacgccactttggtagccggatacaataagtggaaagaccagtttgagcgtcatgtaaaaaagggcgagcatggcattaccatcatcgcccccacaccgtacaagaagaaaatcgaggagcagaaactggacccggataccaaggctccgattttggataaagacggaaagatcatcacagaggaaaaagaaatcgagatccccatgtttcgcccggtcaaggtctttgatgtgagccagactgatgggaaacctttgccggagcttgcctcctccctttccggcaatgtgcccaattatgaggcattcatggaggccctgcgccgcagtgcgccggtgccgatcacttttgaagcaatggccgccgatacggacggctatttttctgccgatcatcagaaaatcgccgttcgtcagggcatgagcgaggtgcagacggtttcggccacggtccatgaaattgcccacagtaagctccacaatcagaaaaagattcagattgccaatgacgagaagtatcaggagatcgagctgtttgataaccccggcctgttctccaacggacggattgcccgtgataatctaccggagggcgtttattgctatgacctgcgcggttctgattacgaccccggagagccagtctgtgtagaagaacgagtggttgtaaaccatgcaggctccgttctgctgacagagccgctggagctggcggaagatggacgactgatgctgaccgaggaaaaagggctgaattttaccggtggcttttctaccctcacccagtttttgcaggaacagaagaaagaccgtcacacggaagaagtagaggctgaaagcatctcctatgcagtctgcaaatattttggcattgagactggagaaaacagctttggctatattgcaagctggagtcagggcaaggaactgaaagagctgagagccagtttggagaccatcaacaagacctccggcactttgatctctgacattgagcgccactataaggaaatctgcaaagagcgtggaattgaccccaatgcaaaaaaagagccggaaatggcggttcttgatgcggaggcaaaccagcaggaggctttgtttctaattgacgatgccacctatcttcatatccagccttgtgacagcggctgggactacaccctttacgatgccgcgtccatgaaagagctggatggcggtcagctggatatgccagagctttcccgcatgaaggcagttctccagatttgtgatgacaacggtctggacagagactctgtaaaatacgcaccgttgtccatgatcgagactttgcaggaagctgcctaccagcagatgcaggcagaggccagtcagatgactgcttcttcccagctgccggaggcacaggggcaggcgctggatgaatacccaacgccggatgagcaggtctccacaccggatatgcaggaatacggttactcttatgacgggatgctccctgttacaagagaacgggcgctggaactggatgccgccggtttgactgtctatgtgctgcatgaggacaatacggagagcatggtgtttgacccacaggagatcatggagcatggcggtcttttcggcgtggaccgtgaggaatgggagaaaagccctcagttccacgaaaaggtcatggagcgtcaggaacatcagcaggaacgagaacaggcatttctctcccagaatagagattgctttgccatctatcaggtaagccgtgacgatccgcagaatgtgcgctttatgaatctggactggttaaagtcccatggcatttccatagaccgcagcaattatgacctaatctacaccgctccgctgagtgagtctggcactgtgccggagcagctggaaaaactctatcagcaattcaatctggaaaaacccgtggactttcacagtccctccatgagcgtcagcgacatcgttgcgatcaagcaggacggtaaggtatcctgtcattactgtgacagcgttggttttacccagatccccggattcttgccgcaaaatccgctgaaaaatgcggagatggccgtggaggacgattacggcatgatcgacggtatcatcaacaatggcgcaaaagagcctacggtggcagagctggaacagcaggcccgaagcggtcagcccatttccctgatggacttgactgacgccattcatcggaaggaacgggaaaagaaaaagtccgtcatggagcagctgaaaagccagcccaaagcagaacacaaaaagacagcgcaaaaaaagagcgcagaaagggagatttgatatgggaaactttacttttgaggaaatgaacctgatgtgcatttacaataccggcagccgcaccgggctgattgacagtctgcgtgaaatgcgcggcgagctttcgccggaggaaacggaactgagggagctaaccgacagcgcccttacgaagctctgtgcgatgaccgatgaggactttgaccagctggagctgtacccggattttgaccagtaaacaccataaccgcagggatggggtggcaatttgccaccccaccttttaccccaaaactgaaaggaggacagaataccatgccaaccaaagctgaactatatgcacagatggcggacaaggtggcaacacagctcacggggagctggcaggaatgggcagagtttctcaccactgcttctcgcctttacaagtacccgttccatgagcagctgatgatctacgcccagcgaccggacgctaccgcctgtgcagagtacgatttgtggaatgaaaagatgggccgatatgtaaggcgcggttccaagggaatcgctctggtggatgattccggggacagacctcgcctgcgttatgtctttgacatttcagacaccggaacccgtgaacattcccgcactccctggctgtggcagctggaggagcgccatttggattcagtgcaggccatgctggagcgcacctatgatgtttccggtgatgaccttgcaggacagcttaccgaggtagccggaaaactggctgaggaatactggacggagcatcagcaggacttcttctatatcgttgacggttcctttttggaggaatatgatgagtataacatcggagtgcagttcaaggcagccgccaccgtcagcatcacttacgctttgatgtcccgctgcggactggagccggaacgctacttcgaccacgaagatttcatggcgatctttgatttcaacaccccgtccaccatcggggcgctgggaacagcggtcagccagatcaaccaacaggtgctgcggcagatcggcgtcaccgtccgaaatgcagagcgcgaagccaaccaagaaaggagcaaacaagatgaacaatcccatgacctatatccagaacggagactatctgattcccgacctgaagctgagccagcagccggagaaacctctgggcaagtacggcaggatgaggaaaacctacctaaaggaacaccatcccatcctctacaaccagatgttgctgagcgagaagctgtacccgcaccttctggagatcgacgagaccgcccagaacagactggagcagatgataccccagctggcgaaggaagcaggagccaccgaggaactgaaagccagcgatcccatgaagtgggtggggctgatgaacacctgcaaagcccaggcagaggaaatcctgatggcggagcttatcaacagctgaccctaaacctgttcctctccgaagcggaacagatccaatccatagatgaagcagagaatgtagcgcatacatcctctgctttttcttttacccaaaacgacattgaccatgtgctgcgtttgggcggcaatacagaccgccagagggagtgtgtggttgcagcctttgaaaagcagaaaaccaccgctgagattgccgagatactgaaaacgctgtaccacggcggcaacggccttggtagtgtgagcgcatggtatgctgaggatggtatccatctttcccacgggaagtctgtccgttatgacaggtctgcccaggtcatttcctgggagagtgccgcagagcgcatcggggaacttttggagagcggccagtttgcctccaatgtggaacttgcagaagcggcaggctatgaacgctccctccttgccacaaagttctggaacctatatcacgatctcagtgaggacgccagagaagccggatatttgtcctgcctgtcagagatcaaaggcaatgggttcccggaggagacccaccgcctgacggagcagttgaatgacccggctttccgccagacactcaaggaagaatacgccgccttctggactgcctatcagcaggaccgtgacctgttgcgctttcattaccataggccaagggaaatctgggagaacctgaaagaccttgacctgccccgcaggactttttcttcggacctttcccaagtgccaaccgtccagcatttcattacagaggatgagatcgacaccgccatgaccggcggcagcagttttgccggaggaaaaggccgtatctatgcgttcttcatggaaaaccatacggataaggaaaaagtgagattccttaaagacgagtatggcattggcggacgctctcatgccctgtccggcgcaacacacagcggcgaagatcacgatgggaaaggactgcactataaaaagcaggactgcccggatgttcacttgaactgggaaaaggtttccaagcgcattacctcacttgtccagaaaggccgctatcttaccgaacaggaacaagcgcagtatgacaagatccaggctgaaaaggatctggcagaagaagatgccattcaagcccagcagccggagatagaggaagaaacgccaaagcctacccttcgggagcagtttgagcagtataagcctgtggtgactgccgccatatctgaggatgtggcatatcgaaatgcctgcggtcattccgaccgtgaaaatgctgtcatcgagggcaatgccgctgtgcgccgtgcggttcttggctctaaggatatggagctgatccgcctttattcggatgtgccggagttccgccagcgcctgcaccgggaagtgatcgacgaaacctatccaaagctccatgagcttctgcgccctctttctcaggaagatattgatactgccctttgtgcatggaacggcaatatcgagagtaaacacgctgtcgtccgttatatgaaagaccatgcaagagagaaggataccgctgcatggctggctcaggaatacggtggcagcaacagcccgttcgttgtccgtgccggaagcccggaggaaacacagctgccctggccgaaggtacagcgcaggcttgcccagctgattcaggaggaccggttctataccgaagaagaacaggatcgttttgacaatatcgaccctatcgccatccgggaagccctggaggaaagagggatcgtcaacggacaggtggcagacccggaaaaactggacaatgacccgtttatccaacaggtgatgtcggatgccgagcagatcgcagctgccgagacagaacagacttccgaggtttccatttccgatgaggaatatgatgcagttcgccgcccgactccgcaaaggacctcctatgacccagccgccccggtctatgccgtgggcgataccgtgtatatcgaggatgacgcctatcagatcacagagctgcgggaggacaccgtacagcttctgcccaccgggatggtatatcccatctaccgggcagagcgcaaagaacagttcgagcagctgcttcgggcagacggccgcaatgcttactataccgagtttctttctattgacccggacaaggcagatcaggacttgcgggatgtattggcccatggactgatggatgaagcggataaaaagcagatttccacgctgctgcaatccggcaggagcaacagcgagatcgcctactggctgagcagagcctattccggtgagatcgagacactgaatctggagaccagcgatattgccgattaccgtaccacggcacagggcatggagctggaagtcctggacgcagaggaaaagcgtctggctgtgctgtatttccgctgggatgaggttgcgcctttgctacgcgggatgtatgcccgtcagctggatggctttggacaggaacaccccgaaccggctgtcgaatccccgaccttccattccgagactgtggccgtctatccgggcgataagaacaatctaccttatgatgtggtggtggaacggttgcatattgaggagccggagccgccagcccctgtaacagagccggagaaaacctttgaggaagtgctggatgaacacccggtttccattcaggtcaacggccagtggcagaccttccccaatgccaaagctgccgaggaagcctcctatgaggaatacaaggacaacctgcgccgcaatgcacagaacttccgcattaccgatgagcatttgggtgaaggcggtccgaaagccaagttccaggcaaatatcaatgccattcgtttgctgaaagagctggaagctgccggacagcaggcaagcccggaacagcaggaagtcctatcccgctatgtgggctggggcggtctttctgatgcctttgacccggagaaaccggcatgggcttccgagtatgcccagctgaaagagctgctgaccccggaggaatatgtcgccgccagaagctccaccctcaacgcccattacaccagccctacggtcattcaggccatctatgaagcggtgggccgtatgggatttgagaccggaaatattttggagccatctatgggtgtgggcaatttcttcggtatgctgccggaggaaatgagaaacagccgtctgtacggcgtggagctggacccggtttccgggcgcatcgcaaagcagctctatcccaaggcggacatcacagtaggcggctttgagaccaccgacaggcgggatttctttgaccttgccatcggcaatgtacctttcggtcagtatcaggtcaatgacaaagcctacaacaagctgaatttcagtattcacaactactttttcgccaaagcactggaccaggtgcgtcccggcggcgtggtggcttttgtaacctcccgctatactatggacgccaaggattccaccgtgcgccgctatcttgcccagcgtgccgaactgctgggagctatccgtctgcccaatgatgcgttcaaaaagaatgccggtgctgaggttgtatcggacatcatctttctccaaaagcgagaccgcccgctggacattgcaccagagtggacgcagaccggacaaacggaggatggatttgccatcaatcggtattttatcgaccacccggaaatggtgctgggcagacaggtgccggtaagcaccgctcatggtatggactacaccgtgaaccccatcgagggactgaagctttccgaccagctgcatgatgcggtgaagtatattcatggcacttatcaggaggcagagctgccggagcttggagaaggcgaagccattgacacctccattcctgccgatcccaatgtgaagaactattcctatgccattgtagacgggcaggtgtactaccgggaaaacagtcgtatggtgcgccctgacctcaacgccaccgccgaagcccgcgtgaaaggtcttgtgggactgcgggattgtgtgcaggaactgatcgaccttcagatggacgcagcggttccggacagcaccattacccaaaagcaggcggaactgaacagcctctatgacagcttttctgccagatatggtctcatcaacgaccgtgcaaaccggctggcttatgcagatgattcttcctattacctgctctgtgcgctggaagtcatcgacgaggacggaaagctggaacgcaaggcggatatgttcaccaaacggaccatcaagccccatcaggcggtggctgtggtggatacggcaagcgaagcactggcggtgtctatctcggaaaaagcctgcgtggatatgggctatatgagccagcttaccggaaaaaccaaagaagaactggccggagaactgcaaggcgtgatctttcgtgtaccgggaaagttggagcaggacggatcgccccattatgtgactgctgatgaatacctttccggcaatgtacgccgcaaactgcgccaggcgcagcgggcggcacagcaggaccaggtttatgcagtcaatgtggaagcccttaccgccgcccagcccaaagacctggatgcgtcggagatcgaggtgcgtctgggcgctacctggatcgacaaagagtacatccagcagtttatgtacgagaccttcaacaccccgttttatctccagcgcagtatcgaggtcaactattcctcctttactgctgaatggcagatcaaggggaaatcttccgtatcctacaacgatgtagcagcttacaccacctatggaaccagccgtgccaatgcctacaagattttggaggacagcctgaacctgcgggatgtccgtatctatgacaccatagaggacgcagacggaaaagagcgccgcgtgctgaacgccaaggagaccaccctggctgcacaaaaacagcaggctatccgggaagcctttaaggactggatctggagagatccggagcgccgccagactctggtgcgccagtacaacgaagaaatgaactctacccgtccccgcgagtatgatggcagccatatcacttttggcggcatgaacccggccattaccctgcgggaacaccagaaaagcgctatcgcccatgtgctgtatggaggaaataccctgttggcacatgaagtaggcgcaggcaaaacttttgagatggtagctgctgcgatggaagccaaacgcctgggcttgtgccagaaatctctctttgtggttcccaaccacctgaccgagcagtgggcgtcggagtttctgcgcctctatccttctgccaacatcttagtcaccaccaaaaaggactttgagacccataaccgcaaaaagttctgcgcccgtattgcgaccggtgactacgacgccatcatcatgggacacagccagtttgagcgtatccccatcagccgggagcgtcaggaacggcttctctatgagcagatcgacgagatcaccgagggcatcgcagaggtgcaggccagcggcggcgagcgttttaccgtcaagcagctggagcgtaccagaaagtctctggaagccagactggaaaagctgcaagccgaggggcgaaaagacgatgtagtaaccttcgagcagctgggggtggaccgtttgtttgtggacgaggcccacaactacaagaacctgtttctatacacaaaaatgcgaaatgtggctggtctttccacatcggacgcgcagaaatcctccgatatgtttgccaagtgccgctatatggacgagatcaccggaaatcgtggtgtgatctttgccaccggcaccccggtcagcaactccatgaccgagctttacaccatgcagcgttatcttcagtatgaacgcctgcaagagctgaacatgacccacttcgactgttgggcttcccgatttggggagaccgtcacagcattggagctggcaccggaaggcaccggctaccgggcaagaacgagattcagcaagttctttaacctgccggagctgatgaacctgttcaaagaagtggctgacattaagactgccgaccagctgaatctgcctaccccggaagtggaataccacaacatcgtggcgcagcctaccgaacatcagcaggaaatggtcaaggccctttcggagcgcgcatcgctggtacacagcggaaccgttgacccgtcccaggacaatatgctcaagattacctcggatggccgtaagttggggcttgaccagaggatcgtcaaccagatgctgccggacgaacctggcacaaaggtcaatcagtgtgtggacaacatcatgcagatctggcgggacggcaaagctgacaagctgacccagctggtgttctgtgatatttctaccccgcaggcaaaagctcctgcaagcaaggcggcgaaaacgctggataatccactgcttcacgcactggaaggcgctgtacctctgccggagcaggaaccggcctttacggtgtatgacgatattcgtcagaagctcattgcccaggggatgcctgctg
